United States Patent 8,221,983 (GENE PRODUCTS DIFFERENTIALLY EXPRESSED IN CANCEROUS CELLS) - sequence listing, part 2

SEQ ID NO: 4471 - DNA, 634 bp, Homo sapiens
aagctcggaattcggctcgaggtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcc

SEQ ID NO: 4472 - DNA, 482 bp, Homo sapiens
tagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgttgtgaataccaagaccacaaatcccataatgtcagcttgat

SEQ ID NO: 4473 - DNA, 356 bp, Homo sapiens
agttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgggtttttttgattgatgttcaatatacccagtacccatggtaggggggggtcatgggcctctgctgggtctcttaggggtcttttccacgggcccctaaaaaagtacaggaggggc

SEQ ID NO: 4474 - DNA, 2019 bp, Homo sapiens
acgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattgggataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaatccttcggattaaacatggaagttatgaagatgctgttcactctggagcccttaatgattgatctgatgttccttttatttataacaatgttaaatgcaatgtcttgtaccttgagttgagtattacacattaaagtaaagtacaagctgtaaacttgggtttttgtgatgtaggaaatggtttccatctgtactttggtcctctgatttcagatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattc

SEQ ID NO: 4475 - DNA, 582 bp, Homo sapiens
taagctcgggaattcgctcgagcggctcgagcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtga

SEQ ID NO: 4476 - DNA, 411 bp, Homo sapiens
  misc_feature 400: n = A,T,C or G
gatctattcatttattttactttctaaggaattgatagaaatataaatgtacatatacctaaaaagtggctatcctacatatgacagcccagaatttactaactccataggttttctggatatttcaagcacacattaaaacaattacagagaggacatacatttatgatttatgcaaattaaggcacatcaattacaatctatttttttaagttagtcagtttaaaaatcttcacttacaaaaattcaaaatatgtccaagctcaactttttagtaggaatgttagtttgttgggtttggccattttcttttttcaccttaaaggtcaaacatgaaacaatgaggaatgtaggtctttgtaaaacacataaatacctgtgatgttttgaatcatttggnccttaaaaata

SEQ ID NO: 4477 - DNA, 556 bp, Homo sapiens; identical to SEQ ID NO: 617

SEQ ID NO: 4478 - DNA, 265 bp, Homo sapiens
  misc_feature 180: n = A,T,C or G
cagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcanagtggagggcaatgtctctattctgcctgcccgatctttaccaaaattcaaggcacctgttacagagggaaggccaagtgctgca

SEQ ID NO: 4479 - DNA, 246 bp, Homo sapiens
atgcatatgtatatgcatataaaagatatatataaaatgggggttataaacaatgaaggaaatagtgatactatctatgtgggaacaatactagtatcctccctttggatgaatacagtagctacagatgcaattctggggactctgttgagcaatagcttaactattgcttggctgcaagcatggataacttgttcaaagaacatgaggagttgtaaatatttaaatacgcaggatttgcaacat

SEQ ID NO: 4480 - DNA, 367 bp, Homo sapiens; identical to SEQ ID NO: 620

SEQ ID NO: 4481 - DNA, 171 bp, Homo sapiens
ttaaaattgagataggttaggcatctatccaatctcccatgccagtaattctacagaaacagattaggttagctagataagcatgtttacaattaaatttatgctgtatccttctaatcaccactttctcatcaaaatgctcacaaatcatctgcatcattgtccattctt

SEQ ID NO: 4482 - DNA, 625 bp, Homo sapiens
ttaggttattgatttgagatctttcttctttttaatttaagcacctgcagctataagcttccctttagcatggctttgagatctttcttctttttaatttaagcatctgcagctgtaagcttccctttagcactgcctttgttgcctcctcctgagtttgggtatgtcatggttttgttttcatttgcttaaacattttttttgtcctattgtaatataattgtgttgtttttaatagaggtaattaatgaaacacataatgaattgtgcttctgtttttataatattttaagcattcttaactcagaaatgtaaattttagaaaaaaattccaggccaggcacagtggctcacacctgtagtcccagcacttgaggaggccgaggtgggaggatcatctgaggtcaggagttggagaccagcctggccaacatggtgaaaccctgtctttactaaaaatagaaaaaaaatatataaaagctagctgggtatcatggcgggtgcctgtaatcccagctactctggaggctgaggcaggagaatcacttgaatctgggaggcggaggttgcagtgagctgaaattgcaccactgcactccagcctgggtgacagaatgagtccatc

SEQ ID NO: 4483 - DNA, 470 bp, Homo sapiens; identical to SEQ ID NO: 622

SEQ ID NO: 4484 - DNA, 514 bp, Homo sapiens; identical to SEQ ID NO: 3400

SEQ ID NO: 4485 - DNA, 521 bp, Homo sapiens; identical to SEQ ID NO: 624

SEQ ID NO: 4486 - DNA, 67 bp, Homo sapiens
cagttcaactgcttactcccaaaacagcctttttgtaatttattttttaagtgggctcctgacaata

SEQ ID NO: 4487 - DNA, 509 bp, Homo sapiens; identical to SEQ ID NO: 3404

SEQ ID NO: 4488 - DNA, 516 bp, Homo sapiens
taagctcggaattcggctcgagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcagga

SEQ ID NO: 4489 - DNA, 458 bp, Homo sapiens; identical to SEQ ID NO: 3405

SEQ ID NO: 4490 - DNA, 616 bp, Homo sapiens
gctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattact

SEQ ID NO: 4491 - DNA, 584 bp, Homo sapiens
taagctcggaattcggctcgaggttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagc

SEQ ID NO: 4492 - DNA, 580 bp, Homo sapiens; identical to SEQ ID NO: 628

SEQ ID NO: 4493 - DNA, 262 bp, Homo sapiens
  misc_feature 164: n = A,T,C or G
cggctcgagtagtaacttgttttcactattgtttctagcccttggaattatttcttttattacatttttccttcagggtttcacatttggcaaagctggagagatcctcaccaagcggctccgatacatggttttccgatccatgctcagacaggatgtgagtnggtttgatgaccctaaaaacaccactggagcattgactaccaggctcgccaatgatgctgctcaagttaaaggggtataggttccaggcttgctgtaa

SEQ ID NO: 4494 - DNA, 236 bp, Homo sapiens
  misc_feature 16, 39, 121, 124, 126: n = A,T,C or G
gattacaggcgtgagnatcacacccagcctccccctttntttcctaataggagactcctgtacctttcttcgttttacctatgtgtcgtgtctgcttacatttccttctcccctcaggctnttntntgggtggtcctccaacctccaatacccaggcctggcctcttcagagtaccccccattccactttccctgcctccttccttaaatagctgacaatcaaattcatgctatgg

SEQ ID NO: 4495 - DNA, 853 bp, Homo sapiens
ctagtcctgacttcacttctgatgaggaagcctctctccttagccttcagcctttcctcccaccctgccataagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgtcactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 4496 - DNA, 497 bp, Homo sapiens; identical to SEQ ID NO: 631

SEQ ID NO: 4497 - DNA, 250 bp, Homo sapiens
  misc_feature 236, 240: n = A,T,C or G
cttgtttctttgatactcttgctgtaggtcgccgtgaggggtagggaagcatatatactgtagggagaagtatcaaaatcatttaaggtcttttttccaaactagtgttcccctcccacatcccaataactcttggaagtctggtgctccctctaggtgaaaatcatttgctggcttatggagtcactgttgctgagtcccatcccccagttacagtgcagtggaaaaacaggttnagantctagaactt

SEQ ID NO: 4498 - DNA, 384 bp, Homo sapiens; identical to SEQ ID NO: 3409

SEQ ID NO: 4499 - DNA, 618 bp, Homo sapiens
taagctcggaaattcggctcgagcgagggccccatcgatgccgccttcacccgcatcaactgtcaggggaagacctacctcttcagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgt

SEQ ID NO: 4500 - DNA, 463 bp, Homo sapiens
  misc_feature 385: n = A,T,C or G
tgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcagtttaagaccagagccaaattatcccaagagcatacattcnttttggttttcctaactttgtgaaaaaaattgatgcagctgtttttaacccacgtttttataggacctacttctttgt

SEQ ID NO: 4501 - DNA, 732 bp, Homo sapiens
tgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagc

SEQ ID NO: 4502 - DNA, 371 bp, Homo sapiens; identical to SEQ ID NO: 3410

SEQ ID NO: 4503 - DNA, 240 bp, Homo sapiens
ccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttatta

SEQ ID NO: 4504 - DNA, 376 bp, Homo sapiens
tgggaaggacctgtacgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgagctcagacctcttccgcagcaccctggagccggtggagaaggccctgcgggatgccaagctggacaaggcccacattcatgacgtcgtcctggtggggggctccacacgcatccccaaggtgcaaaaattgctgcacgacttcttcaacggcaaggagctgaacaggagcatcaaccctgatgaggctgtggcctatggggctgct

SEQ ID NO: 4505 - DNA, 438 bp, Homo sapiens; identical to SEQ ID NO: 3413

SEQ ID NO: 4506 - DNA, 50 bp, Homo sapiens
gattctggaaaacccggacttgtttctcaccagtgaagccacagattatg

SEQ ID NO: 4507 - DNA, 457 bp, Homo sapiens
ggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacaccttagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagattcccttcccaagtaacagcaacatgtgggaatggagactttggtgactggagtgccttcaaccaagccccatcaggccctgttgcttccagtggcgagttctttggcagtgcctcacagccagcggtagaacttgttagtggc

SEQ ID NO: 4508 - DNA, 509 bp, Homo sapiens; identical to SEQ ID NO: 3414

SEQ ID NO: 4509 - DNA, 275 bp, Homo sapiens
  misc_feature 209: n = A,T,C or G
gggtatttaggttcccatatatgaattgtggggggatattaacatttagaccatagcacctactcatgaaagaacattaataattaacacctctagtgagtatttgtgagtctaggatttacagaacataaggatattgtacaaattttaaaagccaaaatgagttttagtattactaaacaacaactgttcagcaggaaaaaaaaganaatagtaatacagaatccctgtaagcattacctgcactaaactgagcacacaattataactcaagc

SEQ ID NO: 4510 - DNA, 552 bp, Homo sapiens
cgaggttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcatctgaggacttaaagaagcatggtgccactgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccaccccca

SEQ ID NO: 4511 - DNA, 493 bp, Homo sapiens
tgtatcgagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacaggtgagtctggagagatggttccccttctgccttgccagagctgagagtggagaaggaa

SEQ ID NO: 4512 - DNA, 581 bp, Homo sapiens
ttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcag

SEQ ID NO: 4513 - DNA, 325 bp, Homo sapiens
ggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcct

SEQ ID NO: 4514 - DNA, 504 bp, Homo sapiens
ccacgtaagatcatccgcatgtgggcagaaaaagaatgcacaatctcgcaagatgcagagagctggaattccttgtccaacagttgtactacatgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttgg

SEQ ID NO: 4515 - DNA, 603 bp, Homo sapiens
cgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctc

SEQ ID NO: 4516 - DNA, 564 bp, Homo sapiens
cgagtaaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctctt

SEQ ID NO: 4517 - DNA, 581 bp, Homo sapiens
gagcctttgtgctctcaccgccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagt

SEQ ID NO: 4518 - DNA, 500 bp, Homo sapiens
ggatcgaggcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccg

SEQ ID NO: 4519 - DNA, 597 bp, Homo sapiens; identical to SEQ ID NO: 3416

SEQ ID NO: 4520 - DNA, 425 bp, Homo sapiens; identical to SEQ ID NO: 3417

SEQ ID NO: 4521 - DNA, 494 bp, Homo sapiens
cttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctc

SEQ ID NO: 4522 - DNA, 166 bp, Homo sapiens
  misc_feature 87: n = A,T,C or G
tgccgaaatagcttcagagtaattatgaattgccttccaaaaaccactgttttgcacttgcctgcaagaataggaaaaacaaaaggnctgtaaggtggcaggatggcagaaccaaacaagagtagtacaccttggagttttttcgaaatatgggttgggtttttgg

SEQ ID NO: 4523 - DNA, 620 bp, Homo sapiens; identical to SEQ ID NO: 646

SEQ ID NO: 4524 - DNA, 353 bp, Homo sapiens
caggttcactgggaccagggctacaggcacagagtctcctggaaaaggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctt

SEQ ID NO: 4525 - DNA, 67 bp, Homo sapiens
atcgcctcgggggacggagcggaggatacagttctggaaaacaaggcagaagtgatagttcaagtaa

SEQ ID NO: 4526 - DNA, 366 bp, Homo sapiens
agacccccgcgcaaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctg

SEQ ID NO: 4527 - DNA, 105 bp, Homo sapiens
ccctgccgcaccacagtgccaatgcttgtgaggacacatgcccttcgggagccttccagaacaggagggaagacaaagagaaaactttcttcccttctactaaaa

SEQ ID NO: 4528 - DNA, 84 bp, Homo sapiens
atacttcatccctacctttcacctggtagccagagccaaaacactggggattgacatcatggatgcctcttaccttgtttctgt

SEQ ID NO: 4529 - DNA, 249 bp, Homo sapiens; identical to SEQ ID NO: 3421

SEQ ID NO: 4530 - DNA, 396 bp, Homo sapiens
gctcgggaattcgaattctgacatcgctggccttcttggggacatgcttttgctcaggtgacctgttccagcccaggcagagatcaggtgggcagaggctggcagtgctgattcagcctggccatccccagaggtgacccaatgctcctggagggggcaagcctgtatagacagcacttggctccttaggaacagctcttcactcagccacaccccacattggacttccttggtttggacacagtgctccagctgcctgggaggcttttggtggtccccacagcctctgggccaagactcctgtcccttcttgggatgagaatgaaagcttaggctgcttattggaccagaagtcctatcgactttatacagaactgaattaagttattgattttt

SEQ ID NO: 4531 - DNA, 636 bp, Homo sapiens
gcagccaagtcgaaagagagctagctcagaaaagaaaagagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagc

SEQ ID NO: 4532 - DNA, 1448 bp, Homo sapiens
  misc_feature 410, 1096, 1134, 1433: n = A,T,C or G
attgattaaaaggtgacctttcttattggactgataagacaaaaatatagattccaaatctattgacatatgatatcacatccacaaatgtttgcctatttttgtagcattattttggttgcaaagtctcttagggaatgcacaaaaataatacaaccttaaaaatcagactagaagatggaatataagtggtttccttgtaatttttttttaagcttggagaggtaataacacatctttgaattcaaactgaggactgctgcttaatggtgcttttacagggtggttctaaaatttttgagagtcaggtattgctttctctgactgtttaattcaccactggcacgtgtttcctatcctcaagcataagtttaaaagattacaaacctcatgctgctcagttttttctntccagtaaatcagatgcatggtttctctaaatttacatatagaaaatcgagatgtggtgggtattagactaacacttcagtgataggaagaagagactgatttctcatatttgtgtaaaacattctcttacctaactaccatctggtccacattaatttcctctcatagccatagctttccattaccaatgagttttccatgtattcacagcatatgggccaggaaatctttctacagagaatgtgtcccttaggcatatatttcccctagattaccgtattaagaaatgttctccctaaaccatacttatggcattaccataaaattgcctcttgaacacagttaaattgaaagtgctcaaaatgcatatcaattcaggtaaaagaaatcttgctacttggaggggaggtattttttattcttccccactttctctttctaactccctacaaagctatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagacgtgaacctcagaaatgtnaaaacaaaaagtcctagaataaagcattcccttgaatnttaaatgaacatgcttttagcagcctggatacgaagcagactattttcaacaaattgaatgtttccccacttgtgtgagagccaaacaagtgccatacagaaagggacctcttcaatgttaccaaagctttgtggcagcatttaagtgtggtggcgccatagaagtcactatagcatggacgagccacttggcttgctttttcctgctaatcaaagttttaagaagataaaaagctatctttgttatatatgttttgtctaatttgcaatattacagtctcctggggggaaatccaacntccaataataattgt

SEQ ID NO: 4533 - DNA, 607 bp, Homo sapiens; identical to SEQ ID NO: 3424

SEQ ID NO: 4534 - DNA, 572 bp, Homo sapiens; identical to SEQ ID NO: 3425

SEQ ID NO: 4535 - DNA, 357 bp, Homo sapiens; identical to SEQ ID NO: 3426

SEQ ID NO: 4536 - DNA, 574 bp, Homo sapiens; identical to SEQ ID NO: 3427

SEQ ID NO: 4537 - DNA, 548 bp, Homo sapiens
tcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcag

SEQ ID NO: 4538 - DNA, 349 bp, Homo sapiens
  misc_feature 162: n = A,T,C or G
gcagttgaaaaattgaaggatttagagctagaaggcatcactggagcagaaagaaacagcatagccttcaggtcaacttgatactcttcccccatctcattgcttctcactagaatagccacattcataattggaagcctagccagctcaggccaaagttantcattagtccaagggaaaaatgaccgaaaaaggacagcatagtgagttttgtgtaaaagctcatttaaagatcgtcttatttggagatggtgtgccccgcattttagtgttacaatgtatttgagagctgatgctgataataaatggctattttattaaatgctctagtttggcaaaattaaaagtt

SEQ ID NO: 4539 - DNA, 304 bp, Homo sapiens
agagattctttattagttgggcattctttatgaccttttctataaaacagtaaggacattaaaatgtaagatgcatgacaaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagattatgtgtgaacttaacttatattttatttacttacttaactt

SEQ ID NO: 4540 - DNA, 393 bp, Homo sapiens
agatactacctgtggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaacgggagtaccctatttttcggggagcagggggaaaactttccctcctacccagg

SEQ ID NO: 4541 - DNA, 259 bp, Homo sapiens; identical to SEQ ID NO: 657

SEQ ID NO: 4542 - DNA, 342 bp, Homo sapiens; identical to SEQ ID NO: 3430

SEQ ID NO: 4543 - DNA, 188 bp, Homo sapiens
ctgcatcagtaattttaataaagaaaagcatgctctgagagaaagctcgctccttggtctgcagtcctttaaacaaagcagtgcagttcttagccaagggtaagtactgcaactgtcgagagcatcttgtcttccacacagttgggtgactctccgttttgacacaaagataagccttgcccttgttt

SEQ ID NO: 4544 - DNA, 500 bp, Homo sapiens
tgtccaacttcatcaaggcatggtcagctacagcatgaaccctgtggacctgttcgaggccaacgacctgtttgagagtgggaacatgacgcaggtgcaggtgtctcttctcgccctggctgggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccaaccagtcgggcatgactgcgtacggcacgaggaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcg

SEQ ID NO: 4545 - DNA, 292 bp, Homo sapiens
acagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggact

SEQ ID NO: 4546 - DNA, 450 bp, Homo sapiens
cggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcatgagaggcagccagaggccaggtatctgctggccgctgactgacc

SEQ ID NO: 4547 - DNA, 497 bp, Homo sapiens; identical to SEQ ID NO: 3431

SEQ ID NO: 4548 - DNA, 525 bp, Homo sapiens
gtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctg

SEQ ID NO: 4549 - DNA, 520 bp, Homo sapiens
gattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttc

SEQ ID NO: 4550 - DNA, 508 bp, Homo sapiens
tgcaagatacaaggctttagagagcagcataaatgttgacatgggacatttgctcatggaattggagctcgtgggacagtcacctcatggaattggagctcgtggaacagttacctctgcctcagaaaacaaggatgaattaagttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgt

SEQ ID NO: 4551 - DNA, 515 bp, Homo sapiens
ccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaat

SEQ ID NO: 4552 - DNA, 253 bp, Homo sapiens
  misc_feature 220, 221, 239, 242, 243: n = A,T,C or G
ggatttttgaaactttacattctttacggttaagcaagatgtacagctcagtcaaagacactaaattcttcttagaaaaatagtgctaaggagtatagcagatgacctatatgtgtgttggctgggagaatatcatcttaaagtgagagtgatgttgtggagacagttgaaatgtcaatgctagagcctctgtggtgtgaatgggcacgttaggttgtgnnttaaaaattgccgtttcngcnnaattttagct

SEQ ID NO: 4553 - DNA, 513 bp, Homo sapiens; identical to SEQ ID NO: 661

SEQ ID NO: 4554 - DNA, 632 bp, Homo sapiens
acagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctga

SEQ ID NO: 4555 - DNA, 585 bp, Homo sapiens
tcccgttcagccgttgggcccaggctttcctcccctccagtgtgaacactgcagtcccggtgtggtggctccccatgcaggacgggccaggctgggagtgccgccttcctgtgccaaattcagtggggactcagtgcccaggcccttggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaa

SEQ ID NO: 4556 - DNA, 586 bp, Homo sapiens
ggtgcgccagatgcccgggaaaggcctggagtggatggggatcatctatcctggtgactctgatatcaaatacagcccgtccttccaaggccaggtcaccatctcagccgacaagtccatcagcaccgcctacctgcagtggagcagcctgaaggcctcggacaccgccatgtattactgtgcgagacagtctgtcagctcctggtaccttgactactggggccagggaagcctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccc

SEQ ID NO: 4557 - DNA, 576 bp, Homo sapiens
actgaattgaaataaggaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaa

SEQ ID NO: 4558 - DNA, 526 bp, Homo sapiens
ccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaaaagaagaccatccaccttaccctgaaagtggtgaagcccattgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggca

SEQ ID NO: 4559 - DNA, 511 bp, Homo sapiens
aagtggaccaggaggaaccacatgttgaagaacaacagcagcagacaccagcagaaaataggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggaatggagaagaccagccaaagcaagtttatgttgataagttggctgaattaaaaaatctaggtcaacctattaagatacgtttccaggaatctga

SEQ ID NO: 4560 - DNA, 215 bp, Homo sapiens
  misc_feature 202: n = A,T,C or G
gttacttacagtagcacagaaatgttagcatatttatttaaatagtcctgcagcagagaccctgcgattgtaaagtgatttaagtatttctgggtagtgtttgtgatttacggatttgttactgaaaaacaaaaaaaatcactactgtgaatttactactatgtaaccttgtggtcgtatttcattataaataaaataaganttgctcttctgcc

SEQ ID NO: 4561 - DNA, 551 bp, Homo sapiens
aaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccg

SEQ ID NO: 4562 - DNA, 601 bp, Homo sapiens
tccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcac

SEQ ID NO: 4563 - DNA, 247 bp, Homo sapiens
attcgaattcgttacttacagtagcacagaaatgttagcatatttatttaaatagtcctgcagcagagaccctgcgattgtaaagtgatttaagtatttctgggtagtgtttgtgatttacggatttgttactgaaaaacaaaaaaaatcactactgtgaatttactactatgtaaccttgtggtcgtatttcattataaataaaataagaattgctcttctgccaaaaaaaaaatgccccaaaaat

SEQ ID NO: 4564 - DNA, 552 bp, Homo sapiens
caacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacagaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgag

SEQ ID NO: 4565 - DNA, 537 bp, Homo sapiens; identical to SEQ ID NO: 3437

SEQ ID NO: 4566 - DNA, 538 bp, Homo sapiens; identical to SEQ ID NO: 3438

SEQ ID NO: 4567 - DNA, 466 bp, Homo sapiens; identical to SEQ ID NO: 3439

SEQ ID NO: 4568 - DNA, 296 bp, Homo sapiens
  misc_feature 284: n = A,T,C or G
gggatcagccaggggccagcatgagccggagggagggaagtctggaagacccccagactgattcctgcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatntggccgtctctc

SEQ ID NO: 4569 - DNA, 456 bp, Homo sapiens
ctaccctttgcagtgcagtgcagcaaacctcactgtgtccaatacccgagacagttcttctcaccccgcattctatgtggaccaaaacatccatgagcaactggtagatttgatgttacaagccatccagggagcccattttgaagatgttactgagtttctggaagaggtcattgaagccttgatattggatgaggaagttagaacatttccagaagtcatgattccagtgtactgatattttattgggccgaataaaagatctagagctctgtcagatccttttgtatgcatatctggatattcttctctatttcactacgcaaaaagatatggcaaaggtttttgtagaatacattcagcccagggaccctaccaatgggcaaatgtaccataagaccttgctgggagtaattctgagtatctcctgcttattaaagactccgggtgttgtat

SEQ ID NO: 4570 - DNA, 273 bp, Homo sapiens
  misc_feature 51, 85, 170, 178, 201, 204, 234, 235, 243: n = A,T,C or G
attttcatggagagactgcaagagtctatatgtgtttcatccttatttganaaggaatccttgactttgttaggagctctatatntctcctctcatagaaatgccatatattatcaggagactgttaatatctcatgtggaggacccatttgtgcaagcatatctttaanattaaatnttttcaactattgaacatattcntanttttaaataaaggctacagtaaaccattannctggcagnctgtttgtgataggtgcatgtcaagagtgg

SEQ ID NO: 4571 - DNA, 258 bp, Homo sapiens
gtttggccagatttgcccaacataacaatagataaaactctaacggaagatgaagctgttaatgcttccagagctcatgtagctttcccagatttcttcaggacttccacagcagagtggtgggccagagaaattgtggacttttacaatgaaaagatgaagtttgatggtttgtggattgatatgaatgagccatcaagttttgtaaatggaacaactactaatcaatgcagaaatgacgaactaaattatccacct

SEQ ID NO: 4572 - DNA, 450 bp, Homo sapiens; identical to SEQ ID NO: 667
  misc_feature 379: n = A,T,C or G

SEQ ID NO: 4573 - DNA, 212 bp, Homo sapiens; identical to SEQ ID NO: 668

SEQ ID NO: 4574 - DNA, 465 bp, Homo sapiens; identical to SEQ ID NO: 3441

SEQ ID NO: 4575 - DNA, 482 bp, Homo sapiens
ttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttgggg

SEQ ID NO: 4576 - DNA, 492 bp, Homo sapiens; identical to SEQ ID NO: 3442

SEQ ID NO: 4577 - DNA, 566 bp, Homo sapiens; identical to SEQ ID NO: 3443

SEQ ID NO: 4578 - DNA, 528 bp, Homo sapiens; identical to SEQ ID NO: 3444

SEQ ID NO: 4579 - DNA, 496 bp, Homo sapiens; identical to SEQ ID NO: 3445

SEQ ID NO: 4580 - DNA, 259 bp, Homo sapiens; identical to SEQ ID NO: 68
  misc_feature 157, 239: n = A,T,C or G

SEQ ID NO: 4581 - DNA, 538 bp, Homo sapiens; identical to SEQ ID NO: 3447

SEQ ID NO: 4582 - DNA, 522 bp, Homo sapiens
cccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcatggtaagatcacgcattgctcc

SEQ ID NO: 4583 - DNA, 275 bp, Homo sapiens
aagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatg

SEQ ID NO: 4584 - DNA, 281 bp, Homo sapiens
catccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcatgttggcaaggaaagcaacatacagaccaatggggggcaagacgttcaagg

SEQ ID NO: 4585 - DNA, 479 bp, Homo sapiens; identical to SEQ ID NO: 3448

SEQ ID NO: 4586 - DNA, 502 bp, Homo sapiens; identical to SEQ ID NO: 672

SEQ ID NO: 4587 - DNA, 599 bp, Homo sapiens; identical to SEQ ID NO: 3450

SEQ ID NO: 4588 - DNA, 373 bp, Homo sapiens
ccacctccacgggtggtctcggagctgctgcagggtggtacctccaggaagccatcagacccagctcccaaagtgatggacttcaaggaaaaacccagctctccggccaaaggctcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatg

SEQ ID NO: 4589 - DNA, 371 bp, Homo sapiens; identical to SEQ ID NO: 3451
  misc_feature 264: n = A,T,C or G

SEQ ID NO: 4590 - DNA, 155 bp, Homo sapiens
  misc_feature 17, 38, 95, 101, 116: n = A,T,C or G
cagccccaggaaatgcncagtttggccagggctcaggncccattgtcctggatgatgtgcgctgctcaggacacgagtcttacctgtggagctgnccccanaatggctggctctcncacaactgtggccatcatgaagatgctggtgtcatctgc

SEQ ID NO: 4591 - DNA, 612 bp, Homo sapiens; identical to SEQ ID NO: 3453

SEQ ID NO: 4592 - DNA, 478 bp, Homo sapiens
aaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtga

SEQ ID NO: 4593 - DNA, 152 bp, Homo sapiens
agcaagagaagctgacagattcaaatgttcacaaacatttatgttctattttgatagatacataaactatgtttctcattcttatatactttatattagggcatgggattaaagtcaaaatagtggaaaattagtagaaataacatatttta

SEQ ID NO: 4594 - DNA, 141 bp, Homo sapiens
ttatatattcaatgatattattcagtattcaatattatttcaaataatattaaatctcttgttcctgtatctctacatgagctgcactaataatttgaatctggaaattaaaaagtgaaacatttaccgttctcatatact

SEQ ID NO: 4595 - DNA, 256 bp, Homo sapiens
aagctcggaattcggctcgaggggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctc

SEQ ID NO: 4596 - DNA, 124 bp, Homo sapiens
tctgagtcttatcgttgtactgatagaagggtcagatatccccacatggagttgagtgggagaaagagattcactagagaataactccttagagaccaatgtctgtagcaggtgtacagcatct

SEQ ID NO: 4597 - DNA, 497 bp, Homo sapiens
agtttatcatcaactctttcagtggtaaactgtggtttccccaagctgcacaggaggccagaaaccacaagtatgatgactaggaagcctactgtcatgacagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacagtaatgtaaatgtcttactggaaatgacaagtttttgcttgatttttttttttaaac

SEQ ID NO: 4598 - DNA, 575 bp, Homo sapiens
gaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcaccactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtgg

SEQ ID NO: 4599 - DNA, 600 bp, Homo sapiens
ctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcggga

SEQ ID NO: 4600 - DNA, 559 bp, Homo sapiens
gttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttct

SEQ ID NO: 4601 - DNA, 570 bp, Homo sapiens
  misc_feature 526: n = A,T,C or G
tagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgngtcaggagttgaatttggggtgggaggatggatgcaactgaagc

SEQ ID NO: 4602 - DNA, 590 bp, Homo sapiens
ctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgtta

SEQ ID NO: 4603 - DNA, 621 bp, Homo sapiens
ctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccagagtcattcgttctgtggagggacaagtggactcagggcagcgccaggctgaccacagcac

SEQ ID NO: 4604 - DNA, 453 bp, Homo sapiens
cttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacat

SEQ ID NO: 4605 - DNA, 612 bp, Homo sapiens; identical to SEQ ID NO: 3459

SEQ ID NO: 4606 - DNA, 425 bp, Homo sapiens
  misc_feature 209: n = A,T,C or G
ccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttangggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtag

SEQ ID NO: 4607 - DNA, 2787 bp, Homo sapiens
agagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgcggagccctgtctcctctctctgtaataaactcatttctagcccg

SEQ ID NO: 4608 - DNA, 576 bp, Homo sapiens; identical to SEQ ID NO: 3461

SEQ ID NO: 4609 - DNA, 238 bp, Homo sapiens; identical to SEQ ID NO: 3463

SEQ ID NO: 4610 - DNA, 493 bp, Homo sapiens
tcggctcgaggggaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaat

SEQ ID NO: 4611 - DNA, 536 bp, Homo sapiens; identical to SEQ ID NO: 684

SEQ ID NO: 4612 - DNA, 247 bp, Homo sapiens; identical to SEQ ID NO: 685

SEQ ID NO: 4613 - DNA, 462 bp, Homo sapiens; identical to SEQ ID NO: 3466

SEQ ID NO: 4614 - DNA, 534 bp, Homo sapiens; identical to SEQ ID NO: 686

SEQ ID NO: 4615 - DNA, 282 bp, Homo sapiens
cactgattacttgattcccttcttcactgtaatatacaaagtgtgtattgtattcagagcaccatggtgttctggttattggttaactctctgtcttctctactagagtgggaactccttaatgataggaatcttattttatacatctctttatttccagagcctcaaaaactgtcaggcaatgaaatgtggatttcggtaatgtctgaaagatgtgttgaaaatgcaagtgatcacattaagcatcagttggatggtaacataagtactaccttcagagtt

SEQ ID NO: 4616 - DNA, 279 bp, Homo sapiens
ctgtgcacacataaaatactaagaagctaaacttaatatctgcaggtagaagttttaaattcaagattttaaccaaataacagagttaatgctaaaatctcacttttgaagtttatgttgaatattagcattctaatatttaatatttttctatttttgaaataggaaatggaaaagatgcagtaggtttttcaaaagggtatcataggtgagcacttcttatagaagaagaaaactaagaggtagtgctatttacctcttcagcactaagtttatctt

SEQ ID NO: 4617 - DNA, 542 bp, Homo sapiens
aaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagcagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattcctttgaagtgtctcccacagggtggcaggactgggagaatctctgaggcgtgtcttccaggccctcccacagcttgtgccctccacagtgtggactcaggtcccatagacatcaggctggagtcttctctgttgttgagaataataaaagctcattatttatttttt

SEQ ID NO: 4618 - DNA, 402 bp, Homo sapiens; identical to SEQ ID NO: 3467

SEQ ID NO: 4619 - DNA, 445 bp, Homo sapiens
gtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaagggggtgtgccaggcctgaactgagctaagcacctgccccgggctccacacttccatctttcttttgtcttcatttcacctctgtgtttaaagcactgtgtgacatagctccttagagatataacctattgtctgctcattgtcacgtgtgtgtgtgtcatctttgtattcttgcagtggtttcacatttccttacccagtcaagccagtatcccatccttcctcataatgcac

SEQ ID NO: 4620 - DNA, 370 bp, Homo sapiens
aatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttatt

SEQ ID NO: 4621 - DNA, 214 bp, Homo sapiens
tacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgt

SEQ ID NO: 4622 - DNA, 252 bp, Homo sapiens
cacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcct

SEQ ID NO: 4623 - DNA, 322 bp, Homo sapiens; identical to SEQ ID NO: 3469

SEQ ID NO: 4624 - DNA, 204 bp, Homo sapiens
cccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatc

SEQ ID NO: 4625 - DNA, 520 bp, Homo sapiens; identical to SEQ ID NO: 3470

SEQ ID NO: 4626 - DNA, 264 bp, Homo sapiens
  misc_feature 135, 137, 180, 209: n = A,T,C or G
gtgctggccagatggactgatgggctgctatacttgggtaccatcaaaaaggtggacagtgctagggaggtgtgtctggtccagtttgaggatgattcgcagtttctggttctatggaaagacattagccctgcngncctccctggagaggaactcctctgttgtgtctgtcgctctganactgtggtccctgggaaccggctggtcanctgtgagaagtgtcgccatgcttatcaccaggactgccatgttcccagggctcca

SEQ ID NO: 4627 - DNA, 556 bp, Homo sapiens
cctaatcctccctttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacatt

SEQ ID NO: 4628 - DNA, 260 bp, Homo sapiens; identical to SEQ ID NO: 10

SEQ ID NO: 4629 - DNA, 636 bp, Homo sapiens
aagctcgggaattcgctcgaggtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatg

SEQ ID NO: 4630 - DNA, 336 bp, Homo sapiens; identical to SEQ ID NO: 3471

SEQ ID NO: 4631 - DNA, 251 bp, Homo sapiens
tttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaag

SEQ ID NO: 4632 - DNA, 428 bp, Homo sapiens
ccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaataggtggctacattctcatcgttttaattaatgaaacttaaatggcttctcttcttccacatgtcctgtccttgacaagatgggcagtatcacaaaaggtcctggcattctaccatctaacactaggaact

SEQ ID NO: 4633 - DNA, 266 bp, Homo sapiens; identical to SEQ ID NO: 696
  misc_feature 161, 163, 168, 179, 182, 191, 199, 203, 207, 208, 211, 218,219, 224, 226, 227, 234, 236, 245, 246, 248, 252: n = A,T,C or G

SEQ ID NO: 4634 - DNA, 239 bp, Homo sapiens
ctgcagcaggagaacttgaagcctcaagagcagctgaccctggagccctatgagcgggaccacgctgtggtggtcggggtctaccgacctcttcccaagagcagcagcaaatagcacccagctcaggctcgcctgccatctccccaaggctgcattgtgtttgctattattttctgtgtgttttctttgtgagtgttttgttttgttgtttttctattaaactgcataaagaaacggct

SEQ ID NO: 4635 - DNA, 261 bp, Homo sapiens
cctgttcctctgctggacctggggtaggctgcaggggtgggcagtagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagcctt

SEQ ID NO: 4636 - DNA, 112 bp, Homo sapiens
tatgctgtgactttagacaagttaggaaagtacctagcagagtacctgggacataagtaggttttctgtaaatgtttgtgacctttggctccgttgtgaggagagactgagc

SEQ ID NO: 4637 - DNA, 263 bp, Homo sapiens; identical to SEQ ID NO: 699

SEQ ID NO: 4638 - DNA, 215 bp, Homo sapiens; identical to SEQ ID NO: 701
  misc_feature 105, 168: n = A,T,C or G

SEQ ID NO: 4639 - DNA, 282 bp, Homo sapiens
taaactgtcaactagtggcttgctgttggactgtacttctctgagtgaggtgctgtgaggacccctggaaggacacaagggcagaatagtgaaggccgacgctgacttccagaagcaatgagtgggagacatcttcctgccacaccctgagcaacacagttgtgaagagtaaatagacactagtagcttctagactttttccgaattctcatcacataaaatatctccttgtgaaattctggcttattgaggacaaagaagattctggaacacaaaccccaa

SEQ ID NO: 4640 - DNA, 535 bp, Homo sapiens
gtaagctcggaattcggctcgagattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctgaggaaaagaccctgacccctgtgggtcatcagtctgtgacccctgtgagtcatcagtctgtgagccctggaggaacgactatga

SEQ ID NO: 4641 - DNA, 541 bp, Homo sapiens
agctcggaattcggctcgagtgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacg

SEQ ID NO: 4642 - DNA, 609 bp, Homo sapiens; identical to SEQ ID NO: 3474

SEQ ID NO: 4643 - DNA, 344 bp, Homo sapiens
tgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggag

SEQ ID NO: 4644 - DNA, 539 bp, Homo sapiens
  misc_feature 37: n = A,T,C or G
aatccatctacaatgagtttctcgagagaaccgtggnagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggt

SEQ ID NO: 4645 - DNA, 302 bp, Homo sapiens
tgacggttatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagcgtcttgctctgtcgcccaggctgga

SEQ ID NO: 4646 - DNA, 588 bp, Homo sapiens; identical to SEQ ID NO: 703

SEQ ID NO: 4647 - DNA, 242 bp, Homo sapiens
  misc_feature 181: n = A,T,C or G
cccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctnctccagaagattacgaacaggaggaagctgctgtggttgagtatagtgatccttatgctga

SEQ ID NO: 4648 - DNA, 238 bp, Homo sapiens
tttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgt

SEQ ID NO: 4649 - DNA, 568 bp, Homo sapiens
gtacgtaagctcggaattcggctcgaggctgcccttgtagcttccccaaaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctac

SEQ ID NO: 4650 - DNA, 59 bp, Homo sapiens
cctgaatataacaacctttaaaaaaaaaaaaaaaaaaaaaaaaaaaaaggggggggccc

SEQ ID NO: 4651 - DNA, 450 bp, Homo sapiens
  misc_feature 2, 253, 386, 397, 413: n = A,T,C or G
antccccaacttttaatttatcaaagagtttcctttaaaccttctctcttaagactttcattgctcaagttttacaaaagacataaggtcagcagttttgaataatataaatactccaaaatcaatgtctactgctaaatgcagaaaattctccttggttaaagttttacaaacatttcaagtcttaaaaattaggatctatgttttaaatattactttgagttaatacagatgtccaaattaatcataaganatatgctgggtcctcgggccgggcgcggtgggctcacacctgtaatcccaggcactttggggagggccgtaatcccaggctactcggggagggctgagggcagggagaaggcactcggaaccgggggagggtnggagggttgcnggtgaggccgaggatncgtggccactgcatggccagcccggggtgacagagca

SEQ ID NO: 4652 - DNA, 417 bp, Homo sapiens
tacttttaactaataaaataagtggattttgtattttaagatccagaaatacttacacgtgaatattttgctaaaaaagcatatataactattttaaatatccattcatcttttgtatatctaagactcatcctgatttttactatcacacatgaataaagcctttgtatctttctttctctaatgtaggatcatactctcctaaaacttgagtggctgtcttaaaagatctagcgggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaacctt

SEQ ID NO: 4653 - DNA, 652 bp, Homo sapiens; identical to SEQ ID NO: 706

SEQ ID NO: 4654 - DNA, 625 bp, Homo sapiens
tcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaact

SEQ ID NO: 4655 - DNA, 446 bp, Homo sapiens; identical to SEQ ID NO: 709

SEQ ID NO: 4656 - DNA, 320 bp, Homo sapiens
gtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttcaccgtgatcttggcactgcgccacaagtct

SEQ ID NO: 4657 - DNA, 405 bp, Homo sapiens
ctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaaacacccctt

SEQ ID NO: 4658 - DNA, 507 bp, Homo sapiens; identical to SEQ ID NO: 3480

SEQ ID NO: 4659 - DNA, 256 bp, Homo sapiens
ttcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctgg

SEQ ID NO: 4660 - DNA, 566 bp, Homo sapiens; identical to SEQ ID NO: 3481

SEQ ID NO: 4661 - DNA, 511 bp, Homo sapiens; identical to SEQ ID NO: 711

SEQ ID NO: 4662 - DNA, 2689 bp, Homo sapiens
ggctggggcctgaggcctggggctcacccacgcccccgccgacgcctgccgcgccgccgccacccccgccacccggagccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtcacggccctgcgcaagctgcacgcgggcaaggtgcgcgaggacggccgcgtggagatcccgcacctcgacggccacgccagcccgggcgccgacggccaggagcgcgtttccgaaatcatcagcttcgccgagacagatggcctcgcctcctcccgggtccgcctatacttcttcatctccaacgaaggcaaccagaacctgtttgtggtccaggccagcctgtggctttacctgaaactcctgccctacgtcctggagaagggcagccggcggaaggtgcgggtcaaagtgtacttccaggagcagggccacggtgacaggtggaacatggtggagaagagggtggacctcaagcgcagcggctggcataccttcccactcacggaggccatccaggccttgtttgagcggggcgagcggcgactcaacctagacgtgcagtgtgacagctgccaggagctggccgtggtgccggtgttcgtggacccaggcgaagagtcgcaccgaccctttgtggtggtgcaggctcggctgggcgacagcaggcaccgcattcgcaagcgaggcctggagtgcgatggccggaccaacctctgttgcaggcaacagttcttcattgacttccgcctcatcggctggaacgactggatcatagcacccaccggctactacggcaactactgtgagggcagctgcccagcctacctggcaggggtccccggctctgcctcctccttccacacggctgtggtgaaccagtaccgcatgcggggtctgaaccccggcacggtgaactcctgctgcattcccaccaagctgagcaccatgtccatgctgtacttcgatgatgagtacaacatcgtcaagcgggacgtgcccaacatgattgtggaggagtgcggctgcgcctgacagtgcaaggcaggggcacggtggtggggcacggagggcagtcccgggtgggcttcttccagccccccgcgggaacggggtacacggtgggctgagtacagtcattctgttgggctgtggagatagtgccagggtgcggcctgagatatttttctacagcttcatagagcaaccagtcaaaaccagagcgagaaccctcaactgacatgaaatactttaaaatgcacacgtagccacgcacagccagacgcatcctgccacccacacagcagcctccaggataccagcaaatggatgcggtgacaaatggcagcttagctacaaatgcctgtcagtcggagagaatggggtgagcagccaccattccaccagctggcccggccacgtctcgaagttgcgccttcccgagcacacataaaagcacaaagacagagacgcagagagagagagagagccacggagaggaaaagcagatgcaggggtggggagcgcagctcggcggaggctgcgtgtgccccgtggcttttaccaggcctgctctgcctggctcgatgtctgcttcttcccagcctgggatccttcgtgcttcaaggcctggggagcctgtccttccatgcccttgtcgagggaaagagacccagaaaggacacaacccgtcagagacctgggagcaggggcaatgaccgtttgactgtttgtggcttgggcctctgacatgacttatgtgtgtgtgtgtttttggggtggggagggagggagagaagagggggctaaatttgatgctttaactgatctccaacagttgacaggtcatccttgccagttgtataactgaaaaaggacttttctaccaggtatgaccttttaagtgaaaatctgaattgttctaaatggaaagaaaaaaagttgcaatctgtgcccttcattggggacattcctctaggactggtttggggacgggtgggaatgacccctaggcaaggggatgagaccgcaggaggaaatggcggggaggtggcattcttgaactgctgaggatggggggtgtcccctcagcggaggccaagggaggggagcagcctagttggtcttggagagatggggaaggctttcagctgatttgcagaagttgcccatgtgggcccaaccatcagggctggccgtggacgtggcccctgcccactcacctgcccgcctgcccgcccgcccgcatagcacttgcagacctgcctgaacgcacatgacatagcacttgccgatctgcgtgtgcccagaagtggcccttggccgagcgccgaactcgctcgccctctagatgtccaagtgccacgtgaactatgcaatttaaagggttgacccacactagacgaaactggactcgtacgactctttttatattttttatacttgaaatgaaatcctttgcttcttttttaagcgaatgattgcttttaatgtttgcactgatttagttgcatgattagtcagaaactgccatttgaaaaaaaagttatttttatagcagc

SEQ ID NO: 4663 - DNA, 526 bp, Homo sapiens; identical to SEQ ID NO: 3483

SEQ ID NO: 4664 - DNA, 282 bp, Homo sapiens
  misc_feature 142: n = A,T,C or G
catgacaccgggcacccagtctcctttcttcctgctgctgctcctcacagtgcttacagttgttacaggttctggtcatgcaagctctaccccaggtggagaaaaggagacttcggctacccagagaagttcagtgcccagntctactgagaagaatgcttttaattcctctctggaagatcccagcaccgactactaccaagagctgcagagagacatttctgaaatggctgtctgtcagtgccgccgaaagaactacgggcagctggacatctttccagc

SEQ ID NO: 4665 - DNA, 937 bp, Homo sapiens
gttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgag

SEQ ID NO: 4666 - DNA, 291 bp, Homo sapiens
gttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattactatttggtatgattcagtttttaatgttattttaaacttcttatatggttggcatatttctgaaaatttaattccaaagaggaattaaccaaactgtacaggacaatattaacc

SEQ ID NO: 4667 - DNA, 882 bp, Homo sapiens
ctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttc

SEQ ID NO: 4668 - DNA, 256 bp, Homo sapiens
  misc_feature 62: n = A,T,C or G
aatgggctaggccttttttatattgaagcaataattccatttttaccctttgaaattttgtntttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgact

SEQ ID NO: 4669 - DNA, 2481 bp, Homo sapiens
cgaacttggggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcttccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgcctgggaacacgtgtgcacatgcgcactctctcatatgccaccccatgtgcctttagtccacggaccccagagcacccccaagcctgggcttagctgcagaacagagggacctgctcacctgcccaaaggggatgaagggagggaggctcaaggcccttgggggagggggatgccttcatgggggtgacccacgatgtgttcttatcccccccgcctggccaccggcctttatgttttttgtaagataaaccgtttttaacacatagcgccgtgctgtaaataagcccagtactgctgtaaatacaggaagaaagagcttgaggtgggagcgggctgggaggaagggatgggccccggccttcctgggcagcctttccagcctcctgctgggctctctcttcctaccctccttccacatgtacatgtacataaactgtcactctaggaagaagacaaatgacagattctgaccatttatatttgtgtattttccaggatttatagtatgtgacttttctgattaatatatttaatatattgaataaaaaatagacatgtagttgg

SEQ ID NO: 4670 - DNA, 256 bp, Homo sapiens
gtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttga

SEQ ID NO: 4671 - DNA, 10884 bp, Homo sapiens
ctgcagacctgggacctcaagaattgcatttgatgccgaacccagctctaatttcagagtcaaggtctctgcgagtatttaaggaacggatgtaaacctgggggattcgttttgtttccttcaattttccaatgaaatcagagatcctgttcttgggtgtcaacgcagatactagaaggaggtgatacaagagaaaggaaacagcaagcgacgattatggcacggtttcctgtaaacaaggttgagtgtagccacagcctgagcactgtgggagaagagctcataagaaaatgacggtgctgggccttcgtcaccccggggccctccattgttcttgtctttggtctctttttatttgtagaggtccaattatttatttatttagtacaagagggaacgaaattgatctttccattctaaaaggagagtatatatgtataaaaggaagctgtatagatatgggggaagaggtggacagggggaaaaggggagaggacgagagagagaaagggagggagagggacaaggagagacactgggcgagagatcgattaggagagacagaaatgatgaatgaagattaacttcacccaaggcttcgtcgctggaggggaatggaggagctcctgatttgctattactactccaaactgcaaagggctccttcaagtcacctatccacctcctaaggcaagcgtccaatttcaacagcgttcaggaaagtctcctcccgcggaggtctcaccgcttcccactccacccccacaaactctttggaaaagtgccttgaaaaatttaatcctcaatccaatcctggaccaccagcgtcctctgttggtcaccgaaggagggggtgcgcagacaaaactgaagaaactcgagtgccagagaaggccgacaggagttacagcgacctcagcgcgcaattgcgccccgaactttactgaaaagtgtttagattgcagagataagctagaatcccaacgcatcgagaatacagtaatacgaagtcgccttcaaaaaatgacaatgaaaattgcctattaaaggactatttggttaattacgtttcagcagtgcccagtttattgtctttattattcttttgtcgtgggtgtaaactccatttgaaaacataatcagggagaatacccaagacaagaagaacagttgtcatttaaaatatttgaaaagccctgccttaaggagcattcgcttgccggtccactcttaattggggacttgcggtgtagcaacacgtgagagtcttcttgcgttgagaagtaagcctggaaaggcgaaggccccggggcatcttcagatgcgtatttgtgggcccctggggatataaacagcccagcgggtgtaaattaaaccccgcagtgccttggctccctgagacccaaatgtaagtcagaaatgtcccaagacttcgcctgccaacggaattaaattttagaaagctccacgaggtacacacgaatgcggagcgctgtatgccagtttccccgacaccggctcgccgcagggagacctcaccccgagagcggaaggggtaagggcggcggggtcaaggagatcgggggtgctgagttggccaggagtgactggggtgaccgggggtgctgaggtggcctggagtgccggggtggccgggcacaccttggttcttgtagacgacaaggtgacgggctccgggcgtgagcacgaggagcaggtgcccgggcgagtctcgagctgcacgcccccgagctcggccccggctgctcagggcgaagcacgggccccgcagccgtgcctgcgccgacccgcccccctcccaacccccactcctgggcgcgcgttccggggcgtgtcctgggccaccccggcttctatatacgggccggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgccaggtgcgctgcgtgcagcaccgccactggcgccgaagggcctgggggttgctgggtgccgctgcgggagactccgcttttcttctcactggagataatatgtggggaaactgaaggcgctccgggaaaggtgaaggcggtcgccgagggaccctccccagccggccctctacttgctcgattctctaagtgcagagtacttgtaaattgcaaagcgctttcagtgaaaatgggtaaaggtttccggagctgaggggagcggtaccgatgtttagctgttggaaagatcctggacacaggagattctcctcgccccgcacgggtgcacacggactgcaatcccagggatgcttggggatggggggatataggcggatttggaccaaggaaggtgggtaggcacgttgtaggaaatagtacctctcttttaaaatactgactttgcacagccttttggtttgcaaagcaatgtctagtcccggtatgtccaaaaacaagtaaagtggattcgggttttgatatcttctgcggttggaaaacctgaagctgaaaaagaagtaacttcttaaggttacccagcggccacaacagagtgtaggtttgaactccgcgtgccactttcagtaccataccattcttacaactcgggccacccctgcacctgcgccgacctcaaacaaacttccaggtgcgtggtgggtgcgggcaatgtggactaagtcaatttcaatgacacggcaagggaattggaatcagtcctaggctgtctcccttcttaatctgaaatggggggggggaatgagatgttgttaaggggagccccagaagaggaaaaatgcaaacatttggcagagttaccctcttgcttagccactatcagtatcaggcagacagcgactctggtaagggcatcacattgttcccttaaaaaaaggagcgggggttgtttaaatggatttggcagctgttctttcaagcattcttagccagcctcacctagttatatgagaaataaagttcctgccttgcacagctgaaggctgggagaattctccccatcctaattcccccaactccccaacgatcacgttggacagatgtcactgggcaggcccccatctagggctagcaggatgaacagtccctttataatttatgtagctgtagagttccacgcccgggtgaagttattttctggctcggcaaggctggctctgttcacccctgagaaatgctggattcatggaaaggcaagatgcctgaaacatacactggctctggtcagctgttaaagctgctggaggcatttgtctctcggggcaaagttatgtcatttgccaagtgtcgtacattattgtgcattttggggtattcaaaaagtgatcttagaaatactgatacacatcgtcattcttgggctttagcaatcatcatgattaccaccttagtagcactgtagtataggttgatgtgagttataagattataaaaagatctaagtgacttctagaatctatttgacaaaaaaaggtaaattttcgacagtcaaaagtcacaattatctgttgcttaaatagaactgttttgtcttcatgccctagtctgcagcccaggcattaagaagaaaccaaggaaatttaagaaattactcaaggttcttagaaaagaagtataaatacgtttatttacatgttcttagagtatttacattcttagtatctcttttatctcagtatttccttgaaaaagaaagcaagctaagattaaaagaaattgaaaccaaatcctcgcaggtagggacctcctctgtgaggctctgtgctggaccctgggaatgtgtgcttcccaaggtatgaaaccccttggggaactttacagcaggacctcagtgagctgtttggcaggtgaggaaactaagacccagagaggagagggactttcctaaggccctggtgagtgacctgccagtagccacttccaggggagagcagagcatctgcagccaaatcattgcagccccaggtagctttctagatagactgtggaccagatgggccacctgagctccctgctagggttacacattatagccctgtttgtgtagtagagaaatttcatgactctcaattgtggacttaagccgatgcctccagaccttggcatggtccacaggccctgggagcatgggctctgaatgtagcctttgatccccatagcggtcttacagcccctccaagttcattctgaagaaggaatggagtgagaatcctggctgcagatccagtcttgaatttagtcatatacttaaaattccaattcaactgttaacattccagcatccattttaagcatcagactttcttcatttagcactttttattataaaagggagatctgctggagggggatttctcctaccccacccccacccagggaaggaaaagctctttggcacttagaagtctgagccgtgagtgggactttggcattgtctgcatccatgtgctgctgtgttcacccggggtgaaaaggactcacttaggcaggcaccagcaagatgcacagggtctgtgtagaccttgagttttagagatgtaacggggacctagaaaacaagccaccaacatgcttgcatgattctgagcccctgaggcaaaacgctttgcaggtaataattcagttttcccatctgagctggacaccaagctcttataagcgtgtttacctggtagcattgaggacggtactggtcaaccttggaattcccataagggcttgttacaactcagactcgtgccgccactccagcgtttccggagtggagaatgtgcatttcttccaagtccccgggctgccgctgctcccgcgggtgggaggaccacacttggagttgactgcaaaatttctgagccggcgctgcagcagcctcccgtggctcaggtctgccccctgccggtggaagatgaagcatactgccttcacctactgaggggcactgaagcgtttgtctgccttctttagttgcagctacttaggaagagcacctgtcagattgactttcaaacagataacttcttgaggtagagcaaccaccatgtagtgagtagtatgatggaataatacttcatcgaggtatttaaaaaaaaaacctcacttggattgccaactaatattgtcatttacatgtgacctggttgcaacgttaagatttttacaagactgtgatagatattgatgactctcatgtgtttgtctctcttgggcgttttaaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatgtgagagcttttcctcttgttaaaggaggagggcaagacctgccaagcctgggtactcagagcctcttgagggcaattcttactcaacaaaccccagcgcctggctgatgggtgggcaacccctagcccctctgtgccctacctctctcctctccttacataaagaatattgacccttttggagaatcttatgaggatcaagctgaaataacactcttaaaagcatatgggatgtcataaagacctctgcagataatgaaaatattctcataaagatagttttatttacttcatcctctatgcttgttgacctgctattggttccatgccagcttctgtgccttactctgggaagagcaaaaaggagacagggagtgatggttagcttattcgggggactttcgtgctacatcagacataaggtatctgaggagcaaattacaggtcccacttttggtagttgtgcagcatcgtaagatttttaaagcacacattctagagtaaaaactgtgactctgttgctctggtccttcctgatccccagggtccctgccgtagagaaatggaagacacactgaatcacctgaagttcctcaatgtgctgagtcccaggggtgtacacattcccaactgtgacaagaagggattttataagaaaaagcaggtgagtgaggtcctcagtgtgttttcttcctcttctgttgacacagaggagaaacccatgtcaccagcgcccaggctcttgtggccatagctctaactctgagcctgtgcagcaccagtgcccaggacttggtgccagtctcaggaggtcagaccaagggctgctttgacttgttgctctgagtgctgctatattggccataatcctcaaccctagtgcctttccaccacccgcttcccactcctgtcctttcaatggttcacccacaggcggacaagatgctgcccagtggcaccctttataaactgcaagtggacatgttaacacatttgttaatgctgcgtcagggagtgacatttcaaacaactattatagtcagtttccaagaagtgtgacatgaggtcataccacaaaaaagcttaccctgaaatcccacaatcgtcccctttcctactgatgccttcccgatagtgagcaggttgcaatattaagattttgaaaaggctgttgctagatgttggtgactcgtgtgtctctgtctcccttgggcttttcaaggaaatgctagtgagtggggggatgactgcagcatggccagcttggagagcccagccatccccagcacataccaggtgtctgtcttggcgtggaggggatggaacttgaaatcagacactcggtccatgctggggatggccagtctctccaaactggcatgtggtcttcctccgagtcactggcatttccctagaaagtccaagtgagaagaaggcatgagagtcatcaacatcaaacaacagtcttttcaaaatctttatattgcaacatagtcccattcctggaaaaggaatggagtgagaatcctggctacacatcagccccaaatgtagtcattgcctaaaatcccaattaacctgaaaatgatcaaacaaatttaagatatagtaatattaagctgtaataaatatgcttctataggctttgtgttatgtgatggcactatttcaattggctttctaattggacaattgatactatgctatctacagaattggcctttggagacctaagtgagccacagtggcctcagggtgaccatatactaggattcatagcagtggccacagtcagaagcctaagctttcctccattgccattgctcgtttataccacgtttctgtcaaagtcatattcattcaacaaagtcatactgagaaggtgtcatgtgaggctggatgtgggctccaaagtcatagctgtgacattcgcaggcagcgggatgttctcagttccacatttggcagagaagtcagtcaagaggttctacaagggctggtgtccaccttatactcctagaaacacaaaactgcccccacccccgctttcttggagcaggaagttacacccacacgcatgcacaggcgcacactcagcgggcctaggcagcgtggctcttgtgttgccttagctgaaatttctgttgtgctttctcagcatagcagagtcacgctggcaaaccatcatgcgccctggccaccgacctgacaccagacccaggagcattcacttctctgtcttctgtttctctcccacagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctgggctccagggcctcactgtccttggaccagcctcaggggctgggcgtggccactggccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgagtctggaggtcatttatcttcacagagaacgtttatcgcagactgctaagatacatgttctaattaagatgtgatgtgagaacgctgaatgctcgttggagactcagttgaagtgcagctttttttctgtcaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatttgcatgtttagttataagggtttcttttttccttacaagttggaaaaaataattctaatttaagggtaactctttgacaatgaacactgtgagcagcatctggtactcgttgctttgtttgaaaacatgagttgagaccccagccgcacttgcagcctagtgccattagcctgcaggctgtgctggatatctcagggcaagagtcgagcccttttgattttggggggattatttcaatatatttgctttttctttttgttttagttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacgggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattaaaatgttccctgctttcccttttagcaa

SEQ ID NO: 4672 - DNA, 310 bp, Homo sapiens; identical to SEQ ID NO: 720

SEQ ID NO: 4673 - DNA, 258 bp, Homo sapiens; identical to SEQ ID NO: 3489

SEQ ID NO: 4674 - DNA, 553 bp, Homo sapiens
aaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttct

SEQ ID NO: 4675 - DNA, 665 bp, Homo sapiens; identical to SEQ ID NO: 3490

SEQ ID NO: 4676 - DNA, 206 bp, Homo sapiens
aatttcttttctttcatgtaatcttgtcagtagacaaatgatggtgactatattctgtaataagtacatatattatgattaaaaaaaaaagcgtgtactatctgcccaaagagatcataagcactttggagctataaacttcttgtctatttctacttccatggtactgatattctcttctcagataaccaaacaaaaacagctga

SEQ ID NO: 4677 - DNA, 124 bp, Homo sapiens; identical to SEQ ID NO: 3491
  misc_feature 28, 47, 87, 90: n = A,T,C or G

SEQ ID NO: 4678 - DNA, 209 bp, Homo sapiens
caaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatcc

SEQ ID NO: 4679 - DNA, 575 bp, Homo sapiens
tcggctcgagcgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaacccagacctcttaatctctctcttttttt

SEQ ID NO: 4680 - DNA, 57 bp, Homo sapiens
acctttactcccacgcccagtttggcgactacaactaccctgggggtgtggactgtg

SEQ ID NO: 4681 - DNA, 486 bp, Homo sapiens
attcgaattcctggaaagagcccttgggtttgtccgtctttttgtgttggcttcttcccagcctccatccgtccagtgtgccccacttccacattctggctataatttcctttttctccttgttcattgggatttgaggacctatttctaaatcttaatttatagcacaaatatgtgggagcaatgagagttgaaccgttgtttttgttggagatgcagattgtgtcttgaaaatgatgattatatatgcaaattctgccctaccctcaccctcttccaagtttccccccaaaaaggtcacacagtgcggcttcctgtgggaaacaggagcagagctggcctgcagagcccctggggctgtgatgaagctcatatcttatctctgttctattaacaaaatgggagtttgtgggttttaaaaaattccgtttctaaatggaggaatagatgactttctttcttttggtgggggttgggacttgtggc

SEQ ID NO: 4682 - DNA, 563 bp, Homo sapiens
cgagtaaaaatatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaac

SEQ ID NO: 4683 - DNA, 580 bp, Homo sapiens
  misc_feature 513: n = A,T,C or G
taatggaagcatctagcatgtcgtcaaactgaaaggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctanacatgtttatcgtatttgatgctacaggatttgaaattgtattacaaatccaatgaaatgagttttt

SEQ ID NO: 4684 - DNA, 542 bp, Homo sapiens
gcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgact

SEQ ID NO: 4685 - DNA, 570 bp, Homo sapiens
accctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatcgttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgatgctcgtaggatatttca

SEQ ID NO: 4686 - DNA, 568 bp, Homo sapiens
ccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatg

SEQ ID NO: 4687 - DNA, 541 bp, Homo sapiens
ggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctga

SEQ ID NO: 4688 - DNA, 534 bp, Homo sapiens
tgctcagccctgtacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgata

SEQ ID NO: 4689 - DNA, 1862 bp, Homo sapiens
gtggtgggactcgcgtcgcggccgcggagacgtgaagctctcgaggctcctcccgctgcgggtcggcgctcgccctcgctctcctcgccctccgccccggccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacataccggaggtcttgtgtatctgtggccaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttcccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaa

SEQ ID NO: 4690 - DNA, 565 bp, Homo sapiens; identical to SEQ ID NO: 725

SEQ ID NO: 4691 - DNA, 555 bp, Homo sapiens; identical to SEQ ID NO: 727

SEQ ID NO: 4692 - DNA, 616 bp, Homo sapiens; identical to SEQ ID NO: 3496

SEQ ID NO: 4693 - DNA, 441 bp, Homo sapiens
  misc_feature 286: n = A,T,C or G
taagctcggaattcggctcgagctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattaccccggctgggtggccggctcttggtgatagattcgccaccactgggccttgttttccgctaattccagggcagattccanggcccagagctggacagacatcacaggaatacccaggcctgggaggaggccccacggcctgctggtggggtctgacctggggggattggagggaaatgacctgccctccaccaccacccaaagtgtgggattaaagtactggtttctttccactt

SEQ ID NO: 4694 - DNA, 265 bp, Homo sapiens
gcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatacttt

SEQ ID NO: 4695 - DNA, 251 bp, Homo sapiens
gccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcc

SEQ ID NO: 4696 - DNA, 96 bp, Homo sapiens; identical to SEQ ID NO: 3499

SEQ ID NO: 4697 - DNA, 459 bp, Homo sapiens; identical to SEQ ID NO: 3500

SEQ ID NO: 4698 - DNA, 360 bp, Homo sapiens; identical to SEQ ID NO: 3501
  misc_feature 360: n = A,T,C or G

SEQ ID NO: 4699 - DNA, 271 bp, Homo sapiens; identical to SEQ ID NO: 41

SEQ ID NO: 4700 - DNA, 392 bp, Homo sapiens; identical to SEQ ID NO: 3502
  misc_feature 390: n = A,T,C or G

SEQ ID NO: 4701 - DNA, 302 bp, Homo sapiens; identical to SEQ ID NO: 731

SEQ ID NO: 4702 - DNA, 297 bp, Homo sapiens; identical to SEQ ID NO: 3505

SEQ ID NO: 4703 - DNA, 534 bp, Homo sapiens; identical to SEQ ID NO: 3506

SEQ ID NO: 4704 - DNA, 443 bp, Homo sapiens
gggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttaatgcttatctaa

SEQ ID NO: 4705 - DNA, 93 bp, Homo sapiens; identical to SEQ ID NO: 734
  misc_feature 11: n = A,T,C or G

SEQ ID NO: 4706 - DNA, 415 bp, Homo sapiens
aagctcgggaattcgctcgagggaggttgaggcaggagaattgcttgaacccgggagacagaggttgcagtgagccgagattgcaccactgcactccagcctgggtgacagagcaagacttcgactcaaaaaataaaataagcgtatctggatttttcttttgaattcttgactgataagtttgagaatgtatgtttttggaattttacagttgactcaagtgtgaaagtatacacaagtaatttttcttttctagctatgtgaatgtaaaatacttgcagataatgtatatattgtgtaatatatgtatatttggtcataaaagcagataattggaaacattgtaaaattaagcactttaattcctattaaatattaaacatttgtatcttgtaaataaacacatccttaaatt

SEQ ID NO: 4707 - DNA, 319 bp, Homo sapiens
taaattcgcggccgcgtcgaccaacatcacttagcaactaggcaagggagacagaaatgaggggtaaacagcactcttcaacacaagtgaactgctgggattacatcatctgaagatggggctggtgcaaaatagttcttgctaaagattcatacctcagaggtaacctctacatcggtatcatcacttaaggacttagagtcctccaggtcatcattttttcccacttcaatcacctgtgaaggcaaaaacatctcattagtaatgtttacttgttttagatgaggctaattaactgaaagcaaaaaaaaagtcgacg

SEQ ID NO: 4708 - DNA, 386 bp, Homo sapiens
atggggtcctgtcccaagagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcct

SEQ ID NO: 4709 - DNA, 299 bp, Homo sapiens
tgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcagttgtgtgcccctaaatcaagatttgcttc

SEQ ID NO: 4710 - DNA, 214 bp, Homo sapiens
ctcgagccgcacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaa

SEQ ID NO: 4711 - DNA, 358 bp, Homo sapiens; identical to SEQ ID NO: 3511

SEQ ID NO: 4712 - DNA, 373 bp, Homo sapiens; identical to SEQ ID NO: 3512

SEQ ID NO: 4713 - DNA, 545 bp, Homo sapiens; identical to SEQ ID NO: 737

SEQ ID NO: 4714 - DNA, 290 bp, Homo sapiens; identical to SEQ ID NO: 341

SEQ ID NO: 4715 - DNA, 586 bp, Homo sapiens; identical to SEQ ID NO: 738

SEQ ID NO: 4716 - DNA, 580 bp, Homo sapiens; identical to SEQ ID NO: 3516

SEQ ID NO: 4717 - DNA, 541 bp, Homo sapiens; identical to SEQ ID NO: 3517

SEQ ID NO: 4718 - DNA, 351 bp, Homo sapiens
cgtgttctgctagtaaatagttgaaggttgatcattgatctcctgcgttttcagtctggcatggaaaagcccccgtgcaactggtaaagatatcaataagcaccaggaggtatctaaatccaccaggagccataggcatcacattgacgtccatttaccagtcttccctggcaagattcttctgaattgtgctgccttgaccaaaagaggtatgggaggggctgggcgcagtggcttgtgcctgtaatcccaacattttgggaaaccaattcaggtggatcattagaggtcaggggttcaagaccatcctggccagcatggtgacatcccgtctctactaaaaatacaata

SEQ ID NO: 4719 - DNA, 251 bp, Homo sapiens
ggtttccccttttgcttggctctcattctctcttgtctgctgccatgtaagatgtgccttttgccttccaccatgattgtgaggcctcccagccacatggaactgtgagttcattaaacctctttttcttcataaattacccagtctcgggtatgtctttatcagcagtgtaaaaacagactaatacaccactcctctaccttctttattttctcagtgtggaaaatgcctgatgaaagctttggggccct

SEQ ID NO: 4720 - DNA, 94 bp, Homo sapiens
ggacataggaggtgctgtgtcccatgccctcttgccctgacagtgtcccatgggcccccttctgctccctgccccctccctgctactgctgatg

SEQ ID NO: 4721 - DNA, 378 bp, Homo sapiens
cgagttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaac

SEQ ID NO: 4722 - DNA, 482 bp, Homo sapiens
gctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctca

SEQ ID NO: 4723 - DNA, 528 bp, Homo sapiens
ttcactcagaacccaggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctg

SEQ ID NO: 4724 - DNA, 542 bp, Homo sapiens; identical to SEQ ID NO: 3518

SEQ ID NO: 4725 - DNA, 633 bp, Homo sapiens; identical to SEQ ID NO: 3519

SEQ ID NO: 4726 - DNA, 519 bp, Homo sapiens; identical to SEQ ID NO: 3520

SEQ ID NO: 4727 - DNA, 271 bp, Homo sapiens; identical to SEQ ID NO: 743

SEQ ID NO: 4728 - DNA, 610 bp, Homo sapiens; identical to SEQ ID NO: 3521

SEQ ID NO: 4729 - DNA, 320 bp, Homo sapiens
taaactgacagtccttcgataatatgaaacattaatttacaaggacccgttagggcttcaatgatgctgagtctggaaaaggggaggagacccttgggaggactccaggcagctgtgctcccagggctcatgttctctactggattagggataggcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctctt

SEQ ID NO: 4730 - DNA, 260 bp, Homo sapiens
gttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggatt

SEQ ID NO: 4731 - DNA, 629 bp, Homo sapiens; identical to SEQ ID NO: 3524

SEQ ID NO: 4732 - DNA, 133 bp, Homo sapiens
agcctacaaacagctattgattttattagcagcaaattatcaccattaaagccagtggtttttttgtttgttttttttttggtttttttttgggaaaaaaaactttttgcccccaagggggaaaaaaaagggg

SEQ ID NO: 4733 - DNA, 168 bp, Homo sapiens
taaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgat

SEQ ID NO: 4734 - DNA, 458 bp, Homo sapiens
gcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaag

SEQ ID NO: 4735 - DNA, 337 bp, Homo sapiens
ataaaatacttctacgcaaaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcct

SEQ ID NO: 4736 - DNA, 561 bp, Homo sapiens
agcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatcccccc

SEQ ID NO: 4737 - DNA, 392 bp, Homo sapiens
ctactgagcccctgccagccatggtccaaactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattcagcaagcatctaaagttgagaaggtgttttttaccactgcagtaccagtagccagtagcccagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctcc

SEQ ID NO: 4738 - DNA, 491 bp, Homo sapiens
acattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggtaaaactgctgctcactgcttttggcttgggctttatttggagatgagggcatttcatttcttttagtgctcgaatattcttaaggctgccgtaagtcaaatgaattgccgaaatgctgcagttcatttttaaatgcagcctaatgatactggtgatgataaataacagtaactgacagttacatagtatttatatttaccaattgcca

SEQ ID NO: 4739 - DNA, 427 bp, Homo sapiens; identical to SEQ ID NO: 3528

SEQ ID NO: 4740 - DNA, 404 bp, Homo sapiens; identical to SEQ ID NO: 3531

SEQ ID NO: 4741 - DNA, 396 bp, Homo sapiens; identical to SEQ ID NO: 749

SEQ ID NO: 4742 - DNA, 505 bp, Homo sapiens; identical to SEQ ID NO: 3533

SEQ ID NO: 4743 - DNA, 314 bp, Homo sapiens; identical to SEQ ID NO: 750

SEQ ID NO: 4744 - DNA, 563 bp, Homo sapiens; identical to SEQ ID NO: 3535

SEQ ID NO: 4745 - DNA, 303 bp, Homo sapiens; identical to SEQ ID NO: 3537
  misc_feature 37: n = A,T,C or G

SEQ ID NO: 4746 - DNA, 440 bp, Homo sapiens
cgagacaaccccagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggtgagcggggaagctggtcggtctgtgggagggggcatttgtttggaaaatgcgggtttcaggccaagctcggtggcccacatctataatcccaatgctttggaaggctgagggaggaggattgcttgagcccaggagttcaagatcagcctgggcaacatagcaagaccttttctctac

SEQ ID NO: 4747 - DNA, 552 bp, Homo sapiens; identical to SEQ ID NO: 753

SEQ ID NO: 4748 - DNA, 589 bp, Homo sapiens
cactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaattt

SEQ ID NO: 4749 - DNA, 330 bp, Homo sapiens
taagctcgggattcggctcgggggccgtggcactgaggccgaagtgcctgccagacggcacggtctgggtgcgggtgttccctgtgagcccgagtccgcttcaggaggggagcctgcaggtgccggctggtgaggggatgacccgctgtgggtgggaggaggcaccgcccatctcagcagcaccaggactgcctgggactccctggcaacccagcaccggggaagccgtcagctgctgtgacaataaaacctgccccgtgtctggagaaaaaaaagggtttaggggaagggtttttttttttttaaaaaaacccccaccccgccccccct

SEQ ID NO: 4750 - DNA, 2056 bp, Homo sapiens
caaatatagagactctccaagggcccactgagccccaaaggatttggatcaaatatggtgatattatggaaatatgtagtaatatcttaaaaatgtgtaagatatagtctctttttttttttttttaagagaaggggtctcactatgtttttaggctggtatcgaactcctggtctccagtgatcctcccacctcagcctgtcaaatagctagaaatataggcatgtaccaccatgctggcttaagatgcattctttgacacagcaattctatttctataagtttatccatataggtaagagaacatatatacaagataatcactgtaactttacttattactgcaaaagtttaaaaataaccaaattgtaataattttataatattttatcagtacaaaaaataagtgatggcatatacaaaccctgggatagtataaggctattaaaattataatagcattccatgtattttgatatacaaagtgccaatgttacaggtgaaaaaagcgaagtgcagaatactatgtgtaactgttaatagtgatggtttgctgggtcagaactgaaggcctgggggtagaaatgagagctcatgacttctaccttttgaatgttgttccttgtgcatgatttacaattttctaaaactaaaaaaaaaatctcagaaaggggctgtacgcacctaaattactttgatattccccaaagtggagagaagtacccgctacacattttatgtgatgcattcagatcacaccaactccttgaactaaatccgaatttttattttaatctgataaacttggcctactattttactgaactcatttcccctatagcctgataaggtcattgacctctccatactggcaccagcgggagactactcacctcgagatctcaaaagcctcctacatgaggttagtaatatccctgaatcctgcaatgaattaactctctactccactgggtcccaggtctgcccccagagagtcatccagagagtaccagggaccatcttcagaaaacaagaggcatttgatccccaaacttcttgaatgaaagcgctgttgtttttcttttttgaatatataaaagtaaatactcaagcagatgggaaacagaacaggatagtaatacccttatcatcattaacaccttggatcaagaagaggcattaagcatacagactcacgctttgatgaaagctgggagaaagaggagcatcaaagggatcttgagaacaaaggcagtccttcccctcccaatcacatgcccacctcctctcactgcagcttctgtctcaggtcttctcccagcagagctataaatccaggctgactcctcactccccacatatccactcctgctctccctcctgcaggtgaccccagccatgaggaccatcgccatccttgctgccattctcctggtggccctgcaggcccaggctgagtcactccaggaaagagctgatgaggctacaacccagaagcagtctggggaagacaaccaggaccttgctatctcctttgcaggaaatggactctctgctcttagaacctcaggtaggagacatcaatcttgcacatctgcaaaatctagaaaaaaaggattggagaaaggatctggagtcaagtgtggaaaggtctacctcacttgagtgactttacttaatcttcctggaccttgattttctcatctataaattaatcagtgagaaccaaataaatctaaaagattttcttttttctaagactttcagctccaagatatttctgtgaaatttgctacttttaagatagaaagagctacactgactagttctttgtagatctaaatgggcagacttagttatatagagagtgttttactttgtccattggaaaagcttttagaacctagagaggaacctataggtgtgttttgatgtaggctaataggcttgattaaatctttctacaatacatccttagatcaaaacatcatattgtgtctcatacatatacacaattattgtttgtcaattaaaacaagtaaatatgtaaaatgtt

SEQ ID NO: 4751 - DNA, 142 bp, Homo sapiens
  misc_feature 13, 61, 67: n = A,T,C or G
accctactctgtnatcccaagtgctcttattctggtgagaagaaccttacttccataattngggaangaatggaagatggacaccaccggacaccaccagacactaggatgggatggatggttttttgggggatgggctagg

SEQ ID NO: 4752 - DNA, 240 bp, Homo sapiens
gtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatg

SEQ ID NO: 4753 - DNA, 142 bp, Homo sapiens
agaaactcaagattgactcatgaggacctgaagggtgacatcccaggaggggcctctgaaatttcccacaccccagcgcctgtgctgaggactccctccatgtggccccaggtgccaccaataaaaatcctacagaaaattc

SEQ ID NO: 4754 - DNA, 377 bp, Homo sapiens; identical to SEQ ID NO: 3539

SEQ ID NO: 4755 - DNA, 262 bp, Homo sapiens; identical to SEQ ID NO: 63

SEQ ID NO: 4756 - DNA, 394 bp, Homo sapiens; identical to SEQ ID NO: 755

SEQ ID NO: 4757 - DNA, 280 bp, Homo sapiens
tcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaatta

SEQ ID NO: 4758 - DNA, 560 bp, Homo sapiens
cagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccg

SEQ ID NO: 4759 - DNA, 547 bp, Homo sapiens; identical to SEQ ID NO: 757
  misc_feature 461: n = A,T,C or G

SEQ ID NO: 4760 - DNA, 521 bp, Homo sapiens; identical to SEQ ID NO: 3541

SEQ ID NO: 4761 - DNA, 417 bp, Homo sapiens; identical to SEQ ID NO: 3543

SEQ ID NO: 4762 - DNA, 212 bp, Homo sapiens
cggctcgaggcccctttgctatctagaatgtgtatgccatagaaatactggatagaggtaggatcagcagctaatctatgagaaattttgtatgattagacacaaaaaattgaatgcttatcctaccgtccagtaaaaaatatttttcggtgtccccaaaaatagcaatttattaatggaaaaatataattttatcactaccactttttaat

SEQ ID NO: 4763 - DNA, 410 bp, Homo sapiens
gcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgc

SEQ ID NO: 4764 - DNA, 529 bp, Homo sapiens
agacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatctt

SEQ ID NO: 4765 - DNA, 547 bp, Homo sapiens
cccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtgaggcccaggcagacaaccttgtcccaaggaatcagcaggatgtgtggg

SEQ ID NO: 4766 - DNA, 569 bp, Homo sapiens
gaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatctgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccat

SEQ ID NO: 4767 - DNA, 371 bp, Homo sapiens
gatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaatccaggagaatcctcggaacttctcggata

SEQ ID NO: 4768 - DNA, 175 bp, Homo sapiens
  misc_feature 47, 74: n = A,T,C or G
ctcaaaggccaggaattccgttgacttgttggctgccagtaggggcnggaggaaaggcggaggcgagccctggnggagggaggccacaactccgagctgcccacctggtgctgagctggggccccgcctcctttctgttttatttttgaggaaataaaataaccaagtgctaaaa

SEQ ID NO: 4769 - DNA, 631 bp, Homo sapiens; identical to SEQ ID NO: 3544

SEQ ID NO: 4770 - DNA, 620 bp, Homo sapiens; identical to SEQ ID NO: 3545

SEQ ID NO: 4771 - DNA, 601 bp, Homo sapiens
tctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacat

SEQ ID NO: 4772 - DNA, 464 bp, Homo sapiens
gtaagctcgggaattcgctcgaaaaatggactttctgctctagatcatataaggcacttcacagatagcctcaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatga

SEQ ID NO: 4773 - DNA, 319 bp, Homo sapiens
aagctcgggaattcggctcgaggaaaagaacatctcagccgggcgtggtggttcacgcctggaatcccagcacttgaggccaggagttccagagcagcctgggcaacgcagtgagagaccccatctctacaaaaaaaaaaaaaaaaaaaaaaaattggaatttccggtttaaaaatttgttaacccccaaagggaaaccattcccttttgaaccccactaaaaccaccaattggcttttaaccccaattcttaaatttttcagaaaaaattttaggttcccgggttttttttttttaaaaaaattaaaaaaatttttgg

SEQ ID NO: 4774 - DNA, 513 bp, Homo sapiens
  misc_feature 477: n = A,T,C or G
actctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtangaaagacctccttcctaaataaaagaagtgtctccc

SEQ ID NO: 4775 - DNA, 411 bp, Homo sapiens; identical to SEQ ID NO: 3552

SEQ ID NO: 4776 - DNA, 626 bp, Homo sapiens
aactgggctctggtaattttggaactgtgaaaaaggctactaccaaatgaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgtt

SEQ ID NO: 4777 - DNA, 586 bp, Homo sapiens; identical to SEQ ID NO: 3553

SEQ ID NO: 4778 - DNA, 516 bp, Homo sapiens
aaagacattttatcattaaaaattacctttaattttaatgctgtttctaagaaaagtagttagctccataaagtacaaatgaagaaagtcaaaaaattatttgctatggcaggataagaaagcctaaaattgagtttgtggaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttactgagcacatatgggctctgactggttttaatagtcaccttcatgattatagcaactaatgcttgaacaaagctcaaagtatgcaatgcttcattattcaagaatgagaaatatactgttgataatatatattaagtgtgccaaatcagtttgactactctctgtttt

SEQ ID NO: 4779 - DNA, 554 bp, Homo sapiens
aacttctgcaacgagcgcttcactcatttgccagaggctgggggcccggaagtcacgtacgagccacccccgacagcccccaccctgctcacggtgctggcctactcactgctgcccatcgggggcctttccctcatcgtcctgctggccttttggatgtaccggcatcgcaagcccccctacggtcatgtggacatccatgaggaccctgggcctccaccaccatcccctctggtgggcctgaagccactgcagctgctggagatcaaggctcgggggcgctttggctgtgtctggaaggcccagctcatgaatgactttgtagctgtcaagatcttcccactccaggacaagcagtcgtggcagagtgaacgggagatcttcagcacacctggcatgaagcacgagaacctgctacagttcattgctgccgagaagcgaggctccaacctcgaagtagagctgtggctcatcacggccttccatgacaagggctccctcacggattacctcaaggggaacatcatcacatggaacgaactgtgtcatgtagc

SEQ ID NO: 4780 - DNA, 551 bp, Homo sapiens
tcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttg

SEQ ID NO: 4781 - DNA, 565 bp, Homo sapiens; identical to SEQ ID NO: 762

SEQ ID NO: 4782 - DNA, 468 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatc

SEQ ID NO: 4783 - DNA, 261 bp, Homo sapiens; identical to SEQ ID NO: 763

SEQ ID NO: 4784 - DNA, 560 bp, Homo sapiens
aagctcggaattcggctcgagcgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccaggggcctctgctccaaaggaggcctctggaacccaggactctggggttttacaag

SEQ ID NO: 4785 - DNA, 332 bp, Homo sapiens
gggccgccctttttttttttttttttaaaaacaaaaaaaatttttttttcccgtaaaagtgaacccgttttaaaaaccccccaaatcccccgggggggaaaattggccaaaaaccctacaaccttttaattaaaaaaagggggccccaaaattttttggtaaaaatttgaggccctttttttccgggaaaggtaaaaaaaaaaaccttttttggcccaggccggggggttccccctttaatccccacctttttaaaagcccagggggggggtttcccctgggggcaggatttcaaaaccccccggcccaattgggaaaacccttttttttat

SEQ ID NO: 4786 - DNA, 530 bp, Homo sapiens; identical to SEQ ID NO: 765

SEQ ID NO: 4787 - DNA, 471 bp, Homo sapiens
ctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggaagagggtacacaatgggtatctaataaatacttaagaggtgg

SEQ ID NO: 4788 - DNA, 253 bp, Homo sapiens
catcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaaccc

SEQ ID NO: 4789 - DNA, 244 bp, Homo sapiens; identical to SEQ ID NO: 2694
  misc_feature 210: n = A,T,C or G

SEQ ID NO: 4790 - DNA, 271 bp, Homo sapiens
caaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcct

SEQ ID NO: 4791 - DNA, 250 bp, Homo sapiens; identical to SEQ ID NO: 3560

SEQ ID NO: 4792 - DNA, 485 bp, Homo sapiens; identical to SEQ ID NO: 3561

SEQ ID NO: 4793 - DNA, 505 bp, Homo sapiens; identical to SEQ ID NO: 3562

SEQ ID NO: 4794 - DNA, 499 bp, Homo sapiens; identical to SEQ ID NO: 3563

SEQ ID NO: 4795 - DNA, 430 bp, Homo sapiens; identical to SEQ ID NO: 769

SEQ ID NO: 4796 - DNA, 478 bp, Homo sapiens; identical to SEQ ID NO: 3565

SEQ ID NO: 4797 - DNA, 395 bp, Homo sapiens
attccaggttgagccttaatcatgtaacaaaatattttgtagattacatattgatttttcaaaaattaaaaatgtatttcaaagtattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggccgaagcg

SEQ ID NO: 4798 - DNA, 291 bp, Homo sapiens
atatcatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagtttt

SEQ ID NO: 4799 - DNA, 376 bp, Homo sapiens
cacaatctactgcaatgatcgtgaacagttatcactggatatagtgctccaagagtcaaattgtatccgttaagggttttctaacttttgctatcccccccgcgaccaaaaaaaggggggtttataatttaaagaaaaggaaaagaggcgtgggttggtacttgcgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaagaaatgtgcttaggactcagtctt

SEQ ID NO: 4800 - DNA, 1179 bp, Homo sapiens
taccgccaccgccgccgccgattccggagccggggtagtcgccgccgccgccgccgccgctgcagccactgcaggcaccgctgccgccgcctgagtagtgtaccgccaccgccgccgccgattccggagccggggtagtcgccgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgctatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgtccagtgtcactctgtaccctcaacatatatcccttgtgcgat

SEQ ID NO: 4801 - DNA, 657 bp, Homo sapiens
cgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaggacagcggccagtggcactactttgatgacaacagcgtctcccctgtcaatga

SEQ ID NO: 4802 - DNA, 223 bp, Homo sapiens; identical to SEQ ID NO: 773

SEQ ID NO: 4803 - DNA, 557 bp, Homo sapiens; identical to SEQ ID NO: 3569

SEQ ID NO: 4804 - DNA, 409 bp, Homo sapiens; identical to SEQ ID NO: 3571

SEQ ID NO: 4805 - DNA, 450 bp, Homo sapiens
gcagtggtgcctaaattagttgtacctccaaaggtttcagaacaggaactggaatcctgagaatcttgtgaaaatatcctcttatgcctcatcacaaatacaccaaatcatctctagtgataggacctggaaatctgtactttcttaaaaggttcttcaggtaaggtttgctgaggtttattacaaatgtacccttgatttgatgctaatgctgtatttagggctgaaggaagcacacactaaatatctgagtgcttttcagattccatctatgctgaaaaagaatctaggagaataaacgcatttcaattagcccttaacatcttgcttcagaactttagcccactaaagcccagtagggcataggagagaacactgcaccaggattcagatctggattctaatttttgttctgaaaaatagcaagtgacactggcatgccatttaacc

SEQ ID NO: 4806 - DNA, 350 bp, Homo sapiens
ctcttaatgaaatacagaaaaaccatctcagaaaaaggaaaatgggcaatcgtcatgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccatcccagcgagtacgccgcccggcagctgcagaaggtatgaagggtctgggcc

SEQ ID NO: 4807 - DNA, 373 bp, Homo sapiens
aattcacttctatatcttgcctaggaactccaggcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggattttttttttaactaccctgaccggtttgctacattcttttttctattcaatatgtgaaaaacaataaaacacttttgacttg

SEQ ID NO: 4808 - DNA, 385 bp, Homo sapiens
ccgctgcgtgttttccttttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttggaaaaaccccaaccccgttggttaaattttttttttttaaaaatttggaaggggaaaaaattttttttaatct

SEQ ID NO: 4809 - DNA, 584 bp, Homo sapiens
  misc_feature 519: n = A,T,C or G
caccctctccctggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatntttgtaaactctggtttttacctttttttcatccccacgttgagttggaggaatagtctcttctc

SEQ ID NO: 4810 - DNA, 260 bp, Homo sapiens
  misc_feature 92: n = A,T,C or G
cttttggaaaatgttaaaggttttgaagtatcttctacaagagacctcttgatacaaacaatagaaaattgtggctttcagtaccaagagtntctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaa

SEQ ID NO: 4811 - DNA, 595 bp, Homo sapiens; identical to SEQ ID NO: 3574

SEQ ID NO: 4812 - DNA, 360 bp, Homo sapiens
ctcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagc

SEQ ID NO: 4813 - DNA, 204 bp, Homo sapiens; identical to SEQ ID NO: 3575

SEQ ID NO: 4814 - DNA, 283 bp, Homo sapiens; identical to SEQ ID NO: 780
  misc_feature 11, 35, 42, 49, 60, 61, 62, 64, 78, 84, 93, 94, 100, 125,137, 142, 143, 167, 207, 210, 217, 257, 265, 269: n = A,T,C or G

SEQ ID NO: 4815 - DNA, 51 bp, Homo sapiens
ctgccacattgagatgatccttacggaaaaggaacagattgttcctaaacc

SEQ ID NO: 4816 - DNA, 563 bp, Homo sapiens; identical to SEQ ID NO: 781

SEQ ID NO: 4817 - DNA, 411 bp, Homo sapiens
ttcggctcgagcttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccc

SEQ ID NO: 4818 - DNA, 489 bp, Homo sapiens; identical to SEQ ID NO: 3738

SEQ ID NO: 4819 - DNA, 312 bp, Homo sapiens
gctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccag

SEQ ID NO: 4820 - DNA, 420 bp, Homo sapiens; identical to SEQ ID NO: 3739

SEQ ID NO: 4821 - DNA, 351 bp, Homo sapiens
cctgagacctgtcaacacccttgagagtgagcctggaagtggaccttctgctcttgaaccttgaggtgactatagagctggctgacacctttactgctgtccctgagctggggggcccagctgatctactcccacagtcccccctactaaaacagtgatataatctaatgctcatgtggttcaagctggtaactttctggaatgcattcactgataaaaattagaatatcaaactataaaccgtttacttagtcaacttttgggggaactaatatggccataaatatcaaacctcctacaatttagcacattctttgactttgaacacctacatctataaacttctcttac

SEQ ID NO: 4822 - DNA, 476 bp, Homo sapiens
agaagggattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttactcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttgtgagtcccagaggttacccaaggcacccctctgacatccgggctgcttcttctcacatgacaaacactagcccccatctcaatcatataccaaatctctccctcactaaacgtaagccttctcctcactc

SEQ ID NO: 4823 - DNA, 143 bp, Homo sapiens
gagaagacgacagaagggaagggacccacaggaagttacagtggtgcccacggatgtgtcagcctccagccacggggacgcgggattcaagaatgaagttgatacaggctcagtcaagaccttaaataaaaatttgtacaaag

SEQ ID NO: 4824 - DNA, 212 bp, Homo sapiens
gagaagacgacagaagggtgtaagcacagagaggggaaaataattgttcactgttctggggtggaaagggactgaagatacaatcaagaaaaatgtgcacaaaactcatcaggaaacattggctaactgtattttctgataccgtggagttgtatttcccatgggaagtatttgaggatctactgagtcactgaagctggaactggccgcac

SEQ ID NO: 4825 - DNA, 343 bp, Homo sapiens
gtctcttttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactgggcaagaagctgg

SEQ ID NO: 4826 - DNA, 451 bp, Homo sapiens
agccagcctgacattacacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcagcaatttctaacagcattttaaatgagtttgatgtacagtaaatattgatgacaatgacagcttttaactcttcaagtcacctaaagctattatgcaggaggatttataagtcacattcataaaacccaagggctatgggtgtattattcatgatagctggcccacaggtcatgaattga

SEQ ID NO: 4827 - DNA, 333 bp, Homo sapiens; identical to SEQ ID NO: 3746

SEQ ID NO: 4828 - DNA, 467 bp, Homo sapiens; identical to SEQ ID NO: 3747

SEQ ID NO: 4829 - DNA, 491 bp, Homo sapiens; identical to SEQ ID NO: 3754

SEQ ID NO: 4830 - DNA, 493 bp, Homo sapiens
cagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcacatgccgaggtggatggtgtggatgaagaggaggaggacgaataaggagaagatgaggaagacgaggacgatgaggatggtgaagaacaggagtttgatgaagaagatgatgaagatgaagatgtagaaggggatgaggacgacgatgaagtcagtgaggaggaagaagaatttggacttgatga

SEQ ID NO: 4831 - DNA, 497 bp, Homo sapiens; identical to SEQ ID NO: 3756

SEQ ID NO: 4832 - DNA, 523 bp, Homo sapiens; identical to SEQ ID NO: 959

SEQ ID NO: 4833 - DNA, 343 bp, Homo sapiens; identical to SEQ ID NO: 2517

SEQ ID NO: 4834 - DNA, 243 bp, Homo sapiens
  misc_feature 243: n = A,T,C or G
gaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgttn

SEQ ID NO: 4835 - DNA, 380 bp, Homo sapiens
  misc_feature 380: n = A,T,C or G
catgtctggctaattctttggatttgtcgtagagatggagtttcaccatgttggtcaggctggtctcaaactactgactatgggagatccacccgcctcaacctcccaaagtgctagagctgaacaagaatccaagcctgcaactgcagagaccagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatctttagn

SEQ ID NO: 4836 - DNA, 401 bp, Homo sapiens; identical to SEQ ID NO: 3765

SEQ ID NO: 4837 - DNA, 322 bp, Homo sapiens
ggctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctca

SEQ ID NO: 4838 - DNA, 370 bp, Homo sapiens
gaaaagatcaaaggctggtccctagcgaagaaagcgctttaatgtgctcctcccgctcccgggtgcgagattcctgcccagctactaggccacgactggctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatcccaccttggacaacctccagaagggagtccaatttgctctcaagtaccagtcgctgggccagtgtgtttacgtgcattgtaaggctgggcgctccaggagtgccactatggtggcagcatacctgattca

SEQ ID NO: 4839 - DNA, 353 bp, Homo sapiens
gagtcagtctcagtcaggacacagcatggacatgggggtccccgctcagctcctggggctcctgctactctggctccgaggttccagatgtgacatccagatgacccagtctccctcctccctgtctgcatctgtgggagacagagtcatcatgacttgccggacaagtcactatataagcagttatttaaattggtatcagcagataccagggacagcccctaagctcctgatctatgctgcatccagtttgcaaagtggggtcccatcaaggttcagtggcagtggatctgggacaaatttcactctcaccatcagcagtctgcaacctgaagattttgcaacttattact

SEQ ID NO: 4840 - DNA, 462 bp, Homo sapiens; identical to SEQ ID NO: 3769

SEQ ID NO: 4841 - DNA, 456 bp, Homo sapiens; identical to SEQ ID NO: 3770

SEQ ID NO: 4842 - DNA, 328 bp, Homo sapiens
  misc_feature 290, 292, 293, 294, 295, 296, 297, 298, 299, 300, 307, 319: n = A,T,C or G
ccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttttcggggggggggggggggggggggaacntnnnnnnnnnggagggncggggggggganccttacctt

SEQ ID NO: 4843 - DNA, 375 bp, Homo sapiens; identical to SEQ ID NO: 3772

SEQ ID NO: 4844 - DNA, 409 bp, Homo sapiens
agaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcat

SEQ ID NO: 4845 - DNA, 335 bp, Homo sapiens
ggagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttaggtaagtgccaggtggagctcaacaggaaagtct

SEQ ID NO: 4846 - DNA, 382 bp, Homo sapiens; identical to SEQ ID NO: 3775

SEQ ID NO: 4847 - DNA, 336 bp, Homo sapiens; identical to SEQ ID NO: 961

SEQ ID NO: 4848 - DNA, 374 bp, Homo sapiens; identical to SEQ ID NO: 3777

SEQ ID NO: 4849 - DNA, 463 bp, Homo sapiens; identical to SEQ ID NO: 3778

SEQ ID NO: 4850 - DNA, 187 bp, Homo sapiens
acagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatg

SEQ ID NO: 4851 - DNA, 520 bp, Homo sapiens; identical to SEQ ID NO: 3779

SEQ ID NO: 4852 - DNA, 462 bp, Homo sapiens
agggggctggcctccggggcaccgaccgctataaggccagtcggactgcgacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaatt

SEQ ID NO: 4853 - DNA, 480 bp, Homo sapiens
ttcatgaatctgtgacgtcagcaagcctttgggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtg

SEQ ID NO: 4854 - DNA, 570 bp, Homo sapiens; identical to SEQ ID NO: 3783

SEQ ID NO: 4855 - DNA, 558 bp, Homo sapiens
agaattgctaaccagtttaatatttaatacttgaaaatgctatttctgttaagaacccacaatttcagctgcacttaacagcccaacctgtaaaaatgcagcctctataagaactttgataccacagcaatttcatcgcctaatacattccacagaagcgctatgcatttagctgaattcaaaacaaagcttattactgcttttcattatgtcttttagtaagatttgatattttatatttatacatacattacttttatttaaaaaattaatttttaaaaaaagcaggaaactgataaatgtataagaatgttctttacctccacagggaaatatgtttaaatccattttcttgaaacatggcccttttggtatagcttttgttctctcccttttgatttaaaaaaaaataggcataagaaatattttacttttctcttttgggttctactgtacctgcatccaagtgtgttccattcctgtccctaatgctgtgaagtttgggcactttctcccgtgcttttgcaaaattgtgattgttgatgatcagacagtatc

SEQ ID NO: 4856 - DNA, 623 bp, Homo sapiens; identical to SEQ ID NO: 3784

SEQ ID NO: 4857 - DNA, 592 bp, Homo sapiens; identical to SEQ ID NO: 3785

SEQ ID NO: 4858 - DNA, 588 bp, Homo sapiens
acatcaagcctgccaacgtgttcatcacagccacgggcgtcgtgaagctcggtgaccttggtctgggccgcttcttcagctctgagaccaccgcagcccactccctagtgggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagag

SEQ ID NO: 4859 - DNA, 506 bp, Homo sapiens
gggactctattgccaagacaagagatgctggctgtaggcatacatggacctgaaagaatagacccaagcgcatcacgacaaggatatgatgtccgctctgatgtctggagtttggggatcacattgtatgagttggccacaggcgagtttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgcaatgtttgtaaaatcctggatcaaatgccagctactcccagctctcccatgtatgtcgattgatatcgctgctacatcagactctagaaaaaagggctgagaggaagcaagacgtaaagaattttcatcccgta

SEQ ID NO: 4860 - DNA, 86 bp, Homo sapiens; identical to SEQ ID NO: 3788

SEQ ID NO: 4861 - DNA, 331 bp, Homo sapiens
ggtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaat

SEQ ID NO: 4862 - DNA, 474 bp, Homo sapiens; identical to SEQ ID NO: 3790

SEQ ID NO: 4863 - DNA, 273 bp, Homo sapiens; identical to SEQ ID NO: 2930

SEQ ID NO: 4864 - DNA, 411 bp, Homo sapiens
aggcaagtggggcatgagccggaagatctggcgaagcttaggcaaaaacaccaccaatcacgtggaagttaattttataaaaaaatttacgtcagaaagagattttcacccatccatcagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgta

SEQ ID NO: 4865 - DNA, 409 bp, Homo sapiens
atgtcagaagaaagtgccaacatgattgcatcagcccttgcccagatcccacaaaaggttctatggagatttgatggcaagaagccaaatactttaggttccaatactcgactgtataagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctatctataaagagaatatcatgaaattatcaagaattcatcatgatc

SEQ ID NO: 4866 - DNA, 153 bp, Homo sapiens
cgagaagacgacagaagggctaagcggcggatgcagtacaaccggcgctttgtcaacgttgtgcccacctttggcaagaagaagggccccaatgccaactcttaagtcttttgtaattctggctttctctaataaaaaagccacttagttcag

SEQ ID NO: 4867 - DNA, 142 bp, Homo sapiens
gaactgacaattaacagcccaatatctacaatcaaccaacaagtcattattaccctcactgtcaacccaacacaggcatgctcataaggaaaggttaaaaaaagtaaaaggaactcggcaaatcttaccccgcctggttacc

SEQ ID NO: 4868 - DNA, 235 bp, Homo sapiens
gagaagacgacagaaggggtggagaatgtgtatttactcactgtgaaaacagcaaagcctcattaactagaaactagccccgggagagggcttgatttgtttaaaaagtccccatgatgcccagagctgtgcaaacatttttaagtgggagaggaggaccactaacatttactgagaggtcactctgggccagccactgttctaactgctttacatgtattatttaactttagtt

SEQ ID NO: 4869 - DNA, 157 bp, Homo sapiens
gagaagacgacagaagggcagtgtatggaggaatggtaagtactttacagctgttgtacagggcagcatgtcctgaaaggggctgcaagaaatgctgattccaagggatgtgtgccagttctctgggggaggaagaaaggctctgtagcagaaagac

SEQ ID NO: 4870 - DNA, 148 bp, Homo sapiens
taagcctgcgtcagattaaaacactgaactgacaattaacagcccaatatctacaatcaaccaacaagtcattattaccctcactgtcaacccaacacaggcatgctcaaaaaaaaaaaaaaaaaaaaacttttggggggcctttttt

SEQ ID NO: 4871 - DNA, 382 bp, Homo sapiens
ggggagtgcaatagcataatctcggctcaccgcaacctccacctcccgggttcaagcgattctcctgcctcagccacctgagtagctgggattacaggagctgccaccacccctcagctaatttttgtatttttagtagacagggtttcaccatgttggccaggctggtctcaaactcctgacctgaggggatctgcctgcctcaacctcccaaagtgctgggattacaggagtgagccaccgtgcccagcctcctccacttctttccttcctttctctctttctctctttctctctctctttctctctttctccttccttccttccttcctctttctgagacagagtacagtggcgcagtcatgtctcactgcaatcttga

SEQ ID NO: 4872 - DNA, 222 bp, Homo sapiens; identical to SEQ ID NO: 3798

SEQ ID NO: 4873 - DNA, 442 bp, Homo sapiens; identical to SEQ ID NO: 968

SEQ ID NO: 4874 - DNA, 516 bp, Homo sapiens
agcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggatcttatcccact

SEQ ID NO: 4875 - DNA, 295 bp, Homo sapiens
aagaagggtgctgccatcccagccaagggggcaaagaatggcaagaatgccaggaaggaagacagtgatgaagaggaggatgatgacagtgaagaggatgaggaggatgacgaggacgaggatgaggatgaagatgaaattgaaccagcagcgatgaaagcagcagctgctgcccctgcctcagaggatgaggactatgaggatgacgaagatgatgaggatgacgatgactatgaggaagatgactctgaagaagaagctatggagactacaccagccaaaggaaagaaagctg

SEQ ID NO: 4876 - DNA, 405 bp, Homo sapiens; identical to SEQ ID NO: 970

SEQ ID NO: 4877 - DNA, 524 bp, Homo sapiens; identical to SEQ ID NO: 3805

SEQ ID NO: 4878 - DNA, 338 bp, Homo sapiens
ggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatccttg

SEQ ID NO: 4879 - DNA, 327 bp, Homo sapiens
gagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagcc

SEQ ID NO: 4880 - DNA, 350 bp, Homo sapiens
atactcaattgatccaataacttgaccaacggaacaagttaccctagggataacagcgcactcctattctagagtccatatcaacaatagggtttacgacctcgatgttggatcacgacatcccgatggtgcagccgctattaaaggttcgtttgttcaacgattaaagtcctacgtgatctgagttcagaccggagtaatccaggtcggtttctatctacttcaaattcctccctgtacgaaaggacaagagatataaggcctacttcacaaagcgccttccgccgtaaatgatatcatctcaacttagtattatacccacacccacccaagaacagggtttgttgcaa

SEQ ID NO: 4881 - DNA, 79 bp, Homo sapiens; identical to SEQ ID NO: 3808

SEQ ID NO: 4882 - DNA, 509 bp, Homo sapiens; identical to SEQ ID NO: 3809

SEQ ID NO: 4883 - DNA, 424 bp, Homo sapiens
agacgacacaagggggactttcccgatcgccaggcacgagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggctactacgctgagcgagtgggggccggcgcgcccgtctacatggctgcggtcctcgagtatctgaccgctgagatcctgtagctggcgggcaacgctgctcgtgacaacaagaagacgctcatcatccctcgtcacctccagctggccatccgcaacgacgaggaactgaacaagctgctgggcaaagtcaccatcgcccagggcggcgtcttgcctaacatccaggccgtactgctccctaag

SEQ ID NO: 4884 - DNA, 358 bp, Homo sapiens
accatttgaagagtcacctagatcttcccttatggaagttcttacataaaaagaatcacctcattgaggagataaactgatgaaatgaggcgttgtcactgtgagctcacgtggtcccaactcaatgataaagttaccatcagaccatcagccaccttagtcaataaaggaagaccgagaatcactacctggcatgcagatacttccacaacactctctagcatcaggtctaaatattaagtcaacccaattaaagtggatccaacaatgtgcgacaccatataaaatgatgtgaaagatgacaggatcttgattgagtttgatacacttaaggagatggtaatcttaccagggaaat

SEQ ID NO: 4885 - DNA, 466 bp, Homo sapiens; identical to SEQ ID NO: 3811

SEQ ID NO: 4886 - DNA, 342 bp, Homo sapiens
cacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtgga

SEQ ID NO: 4887 - DNA, 463 bp, Homo sapiens; identical to SEQ ID NO: 3814

SEQ ID NO: 4888 - DNA, 541 bp, Homo sapiens
gagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcggcaatgccagagagaatatccagagactcacaggccatggtgcggaggactcgctggccgatcaggctgccaataaatggggcaggagtggcagagaccccaatcacttccgacctgctggcctgcctgagaatactgagcttcctcttcactctgctctcaggagacctggctatgaggccctcggggcagggatacaaagttagtgaggtctatgtccagagaagctgagatatggcatataataggcatctaataaatgcttaagaggtgg

SEQ ID NO: 4889 - DNA, 300 bp, Homo sapiens
agatcatgaggtcaggagatcgagaccatcctggctaacacggtgaaatcccgtctctactaaaaatatttttaaaaaattagccgggcgtggtggcgggcgcctgtaatcccagctactcgggaggctgaggcaggagaatggcataaacccaggaggcggaggttgcagtgagccgagatcgcgccactgcgctccaacctgggcaatagagtaagactctgtctcaaaaaaaaaaataagttttttatgaaaaaattttttggtttgggccagtcgcgggggctcacacctgtaatg

SEQ ID NO: 4890 - DNA, 371 bp, Homo sapiens
atctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaagggtagtatcatcagatagcatcttatacca

SEQ ID NO: 4891 - DNA, 120 bp, Homo sapiens
gaggagacactgtgcagatggatgcagaaactggaattttgcctccacaagttaagtaatactaatagctctcggaagctgaaaaaggcaaaaaaaaaaaaaaaaaaaaagtcgtatcga

SEQ ID NO: 4892 - DNA, 158 bp, Homo sapiens; identical to SEQ ID NO: 1646
  misc_feature 134: n = A,T,C or G

SEQ ID NO: 4893 - DNA, 434 bp, Homo sapiens; identical to SEQ ID NO: 978

SEQ ID NO: 4894 - DNA, 130 bp, Homo sapiens
gagggcgaggaagaggaggattaggggagtccccgggggactgctcaatacagatacggtggacgcaaaaaaaaaaaaaaaaaaaaaaaatttttttttttttccccctttttttttttttttttccccc

SEQ ID NO: 4895 - DNA, 500 bp, Homo sapiens; identical to SEQ ID NO: 3824

SEQ ID NO: 4896 - DNA, 597 bp, Homo sapiens
  misc_feature 512: n = A,T,C or G
tagggcgaattgggtaccgggccccccctcgaggcccgtcgaggttccactaacagtcttctcaaggccattccagcctttgcctgatgcccagtcccaaagacaataccatatgttttgggttgggttttttttgttttgttttgttttttaggcaagatctcattctgctgcccaagctagagtgcagtggtgtgatcatggctacctatagtctcaacctcctgggttcaagcaaacctcccatctcagcctcctcagtagctaggaacacagcatgcaccaccatgctggctgatgtttttagttttatagagatgggggtctcactgtgttgcctaggcaagtctcaaactcctgggctcaagcagtccactaaccttggcctcccaaagtgttgggattacaggcgtgagtcaccatgcccagcctccagctgttattgtattgcaatctatcactgtccttagcactaataatgtttggtttatagatctgcatgctggcagtgnttgggtacatatatatttacaattgctatatcctcttgctgagttgacccctttatcattatatagtgatgttgtctctttttat

SEQ ID NO: 4897 - DNA, 502 bp, Homo sapiens
attgggtaccgggccccccctcgagacgtaaattatggctgaatcatccgctaccttcacgccaatggcgcctcaatattctttatctgcctcttcctacacatcgggcgaggcctatattacggatcatttctctactcagaaaccggaaacatcggcattatcctcctgcttgcaactatagcaacagccttcataggctatgtcctcccgtgaggccaaatatcattctgaggagccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgccctcg

SEQ ID NO: 4898 - DNA, 471 bp, Homo sapiens
gcgcccgccgccatgtcggtgctgggcgagtacgagcgacactgcgattccatcaactcggactttgggagcgagtccgggggttgcggggactcgagtccggggcctagcgcagtcaggggccgcgagccgggggacgcgggaaagcaggagggaactgcactacatccccatccgcgtcctgggccgcgcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctggttgagctgggatgttgggatggaggcgacgtgtgtggcgagatcttcggtcggagggacaagttgtttgagggagagatggtggtg

SEQ ID NO: 4899 - DNA, 1017 bp, Homo sapiens
attccattgtatagatacaacttagtttttcttcttatgaatgaggtggaggattttttcataccgaaagcccttatttttctgtggactgtcagatcatgtcctttgcctatttatgtgttgcactgttggcacttttcttaactcaaacctacaataaatgtgtaggttcactggaaaagaatcaggtctgagaggaaagactttgagcttgtcttgggcacaattatgtttgaagcgcttttgagtcatcttaagaggtaatgtgggccaggcatggtggctcacgcctgtaattccaacattctgggaggctgaggcagtaggatcacttgaggtgaggagttcgagaccagcctgagcaacacaataagaccagtctctacaaaaaattttaaaaattatgccgcggtggtgggttgtgcttgtagtctcagcttcttgagagactgagacaggaggatggtttgaacccaggagtttgaggtcacagtgtgtaatgatcatggccactgtactccagtctaggcacggaacaaaccctgtctcaaaagaattataaacacaaataaaaagattaacaaattaagctgggtggctgtgtagatacctgtaattcccgcctactcggtgggcgatgcaggaggatttgcttgagcccggggttggagtacagtactgggcaacatagaagacccattctctaaaattaaaagaagatttttaaaattggtaaacgccagcaggacttttcaggaaaaaaagagaattgccatggtctgttatcaggatttaaaggggggcgctcttccattccccagaattggaaagataaggaatgtttggggcaattattccaatacttttgtggtgttggtggaaatggccaatcacctgggccagcctgggtcacagcgagattggtagtgtcctctttccggataaaattgagatcccactgaaaagttcccttagagaagaccccgcggagggttgtctcgcaagatgtttcgctga

SEQ ID NO: 4900 - DNA, 621 bp, Homo sapiens
gcagagaaaggtttgttttattgcaattatttagagcgcgtcccaaggggccggggaggggggctttgaaggggggggtctctggtattaagtggaaacatgtgtggagctggagatctttttggaaaaaaagcaaaaacacaaattcctttcagtcagcaggccccagcagagcagcaaaggccctcgccccgcggctgccggcgcgtcgctcgctctctctctgtctctctctgtgtctctctctctctctctctgtctctgtctctgactctctctcacatctctgggtctctctccccctatcttgctgccacaggcccccagtacctggtgggcaggggcaggatgggggctcacggggctggggctgatttctgggcaatggcaggaccaccctccagtccactgaggctgggggagctcggggcaggctgagggccaaggtccgtgcgggaggggtcccagggtcccgagacaggcaggaaggggctcagaagttgctgaagatttcacgcttcctgttccagtccatctgtggcgcgcgcttgttgactcgcatggctcgagcttttccttgggctcggcggccgtggggctcaggtggaggccgctctcctg

SEQ ID NO: 4901 - DNA, 608 bp, Homo sapiens
attgggtaccgggccccccctcgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgaggggggaagtacaaagccgctctgaaagccg

SEQ ID NO: 4902 - DNA, 515 bp, Homo sapiens
acaaaaagcttcagcctttattaaacaaaggaggaggtagaaaacagataagggaacagttagggatcccttctttcccctatacatacacagacatacaaacacacgcacccgagtgaatgacagggaccatcaggcgacagattgaagggcagagggaggcagcaccctccgagagttggcccggacccaagggtgggctgagacctgggccaggggcagccgttccgaggggttatgcctgagcagtttggagatgaggtcctgggctcccgtgggcacagaagcggggaactttaggtccaccttgacgatgcggcgataggtctcgttgtgtgatgcactctcaaagggtgggttccccacagcagctcatagcaaagcactccaatgcaccacagatccaccttctcattgtgaatgcgcccctcaatcatctctgggggcaggtagtccagggtgccacacattgtcttcctcctcagggagggcgcatgcacagaccagccgaagtc

SEQ ID NO: 4903 - DNA, 519 bp, Homo sapiens
gacagaaggggtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgagga

SEQ ID NO: 4904 - DNA, 230 bp, Homo sapiens
ttaagaggagcattttctggctgagagcagtggctcacgcctgtaatcccagcactttgggaggctgaggtgggtggatcacctgaggtcaggagttcaagaccagcctggccaacatggtgaaaccccatctctactaaaaatacaaaaatttcctgtaatcccagcactttggaaggctgaggtgggtggatcacctgaggtcaggagttcaagaccagcctggccaa

SEQ ID NO: 4905 - DNA, 357 bp, Homo sapiens
gggggagagacagaaattaacattataaggtctggcgtggtggctcatgcctgtaatcccagcacgttgggaggctgaggtaggtggatcacttgaggttgggagctaaagaccaccctggccaacatgatgaaaccccatctctactaaaaatgtaaaaatttgccgggcgtggtggcaggtgcctgtaatcccagctacttgggaggctgaggcaggaagatcacttgaacccaggaggcaaaggttgcagtgagctgagattgcaccgctgcactccagcctgggtgacaaagtgagactctgtcctccatctcaaaaaaaaagaaggaaaggaaaaaagaaggaacctacctt

SEQ ID NO: 4906 - DNA, 489 bp, Homo sapiens
gagtcgtacgtgggtttgccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgacaattatccatgacttccctcagttttatcctttagggattgtgcaacatgattgatcttgatggattttcatacgattgtaaatgagctatattaaagtctattaaaggaagcccttcttgtttgagggaga

SEQ ID NO: 4907 - DNA, 320 bp, Homo sapiens
  misc_feature 210: n = A,T,C or G
atatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgngcggtcatacctttcttcgttgtggtggggatggaagagcagagggagcatggcccaggggtgttgaggccagcggtgagagccgtgttagccaagacatggaactgtgt

SEQ ID NO: 4908 - DNA, 475 bp, Homo sapiens
ggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagc

SEQ ID NO: 4909 - DNA, 420 bp, Homo sapiens
gcagcagcagtagctatggcagtggcagaagattttaattaggaaacaaagtttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttgcaccccatgctgttgattgctaaatgtaacagtctgatcgtgacgctgaataaatgtcttttttttaatgtgctgtgtaaagttagtctactcttaagccatcttggtaaatttc

SEQ ID NO: 4910 - DNA, 509 bp, Homo sapiens; identical to SEQ ID NO: 3833

SEQ ID NO: 4911 - DNA, 396 bp, Homo sapiens
gctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctgggtcgtaccaagaccctggtgaagaattgcatcgtgctcatcgacagcacaccgtaccgacagtggtacgagtcccactatgcgctgcccctgggccgcaag

SEQ ID NO: 4912 - DNA, 375 bp, Homo sapiens
atataccaatgatggcgcgatgtaacacgagaaagcacataccaaggccaccacacaccacctgtgcaaaaaggccttcgatacgggataatgctatttattacctcagaagtttttttcttcgcaggatttttctgagccttttaccactccagcctagcccctaccccccaattaggagggcactggcccccaacaggcatcaccccgctaaatccgctagaagtcccactactaaacacatgcgtattactcgcatcaggagtatcaatcacctgagctcaccatagtctaatagaaaacaaccgaaaccaaataattcaagcactgcttattacaattttactgggtctctattttaccctcctacaagcc

SEQ ID NO: 4913 - DNA, 484 bp, Homo sapiens; identical to SEQ ID NO: 3840

SEQ ID NO: 4914 - DNA, 494 bp, Homo sapiens
ggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcag

SEQ ID NO: 4915 - DNA, 442 bp, Homo sapiens
actattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactccggaggctgaggcaggagaatcacttgaacccgaaaggcagaggttgtggtgagctgagagtgctctattgcactctagcctgggcaacaagagcgagactccatctcaaaaataaaaaataaaaacagctg

SEQ ID NO: 4916 - DNA, 418 bp, Homo sapiens
actattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggcggcacatgcctataatcccagctactcgggaggctgaggcaggagaatcacttgaacccgaaaggcagaggttgtggtgagctgagagtgctctattgcactctagcctgggcaacaagagcgagactccatctc

SEQ ID NO: 4917 - DNA, 139 bp, Homo sapiens
acctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 4918 - DNA, 430 bp, Homo sapiens; identical to SEQ ID NO: 2507

SEQ ID NO: 4919 - DNA, 468 bp, Homo sapiens; identical to SEQ ID NO: 3843

SEQ ID NO: 4920 - DNA, 125 bp, Homo sapiens
ctgggctcttcaccactgtatttctctcatttacaaaccatcagctgcttttaaaataagatctctttgtagccatcctgttaaatttgtaaacaatctaattaaatggcatcagcactttaacc

SEQ ID NO: 4921 - DNA, 639 bp, Homo sapiens
ggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacag

SEQ ID NO: 4922 - DNA, 416 bp, Homo sapiens; identical to SEQ ID NO: 3845

SEQ ID NO: 4923 - DNA, 501 bp, Homo sapiens
gcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaatt

SEQ ID NO: 4924 - DNA, 254 bp, Homo sapiens; identical to SEQ ID NO: 3848

SEQ ID NO: 4925 - DNA, 444 bp, Homo sapiens; identical to SEQ ID NO: 3849

SEQ ID NO: 4926 - DNA, 448 bp, Homo sapiens; identical to SEQ ID NO: 3851

SEQ ID NO: 4927 - DNA, 340 bp, Homo sapiens
  misc_feature 287: n = A,T,C or G
atccgattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggnttctttgttttggttttgagcaaaagagatcggtagtgttgtgggtaggccat

SEQ ID NO: 4928 - DNA, 357 bp, Homo sapiens
  misc_feature 322: n = A,T,C or G
gcggttccgggcgttaccatcgtccgtgcgcaccgcccggcgtccaggtgagtctcccatctgcagagacgcggacgcgccggcccgcagttggcctgcggagcgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaanaaaaaatccagaaccttgggaaactgtggacccta

SEQ ID NO: 4929 - DNA, 411 bp, Homo sapiens
ggccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccacaagtcaaccagaccaccttataccagcgttatgagatcaagatgaccaagatgtataaagggttccaagccttatgggatgccgctgacatccggttcgtctacacccccgccatggagagtgtctgcggatacttccacaggtcccacaaccgcagcgaggagtttctcattgctggaaaactgcaggatggactcttgcacatcactacc

SEQ ID NO: 4930 - DNA, 392 bp, Homo sapiens
gattcttcccctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccacaagctgatgagcaacttggacagcaacagggacaacgaggtggacttccaagagtactgtgtcttcctgtcctgcatcgccatgatgtgtaacgaattctttgaa

SEQ ID NO: 4931 - DNA, 372 bp, Homo sapiens; identical to SEQ ID NO: 3869

SEQ ID NO: 4932 - DNA, 322 bp, Homo sapiens; identical to SEQ ID NO: 3870

SEQ ID NO: 4933 - DNA, 70 bp, Homo sapiens; identical to SEQ ID NO: 3871

SEQ ID NO: 4934 - DNA, 376 bp, Homo sapiens
gctcctcggccaggcggaacctctctgctgggcccggtggccgcaaaaaaactttctttctcccgcccgaacggacgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactataaggtggaaggaaacctcttcattatgcagcagattgtg

SEQ ID NO: 4935 - DNA, 61 bp, Homo sapiens; identical to SEQ ID NO: 3872

SEQ ID NO: 4936 - DNA, 424 bp, Homo sapiens; identical to SEQ ID NO: 3874

SEQ ID NO: 4937 - DNA, 460 bp, Homo sapiens; identical to SEQ ID NO: 3879

SEQ ID NO: 4938 - DNA, 446 bp, Homo sapiens; identical to SEQ ID NO: 3880

SEQ ID NO: 4939 - DNA, 468 bp, Homo sapiens
cattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaaca

SEQ ID NO: 4940 - DNA, 410 bp, Homo sapiens
aagggacagatcagaatcagtatggatccacgtcattatggagggggacagactccaggccaggagactgatcagttcattcaagaggagttgagggccaggattagtggctcatgcctgtaatcccagcactttgggaagccaaggcaggcagatcacctgaggtcaggagtttgagaccagcctggccaacatgtcgaaactctgtctctactaaagatataaaaattagccgggcatggtggtgggcgcctctaatcccagctacttgggaggctgagacaggagaattgcttgaaccccaggaggcggaggttgcagtgagccaagatcacaccactgcactccagactgggcaacagagcaagactccatctcaaaagatatatatatatatataggccgggcgc

SEQ ID NO: 4941 - DNA, 514 bp, Homo sapiens
caagctccaggacatgcaagagatcatctcccactatgaggaggaactggcgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgatatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttctgtaacagtctcaccagacttctcataatgctcttaatatattgcacttttctaatcaaagtgcgagtttatgagggtaaagctcta

SEQ ID NO: 4942 - DNA, 504 bp, Homo sapiens; identical to SEQ ID NO: 3885

SEQ ID NO: 4943 - DNA, 79 bp, Homo sapiens
gtgcgctgatcctgattatttggcaggaaaacgagacaatccagcagcccaggagggacagatggacttaatcctcccc

SEQ ID NO: 4944 - DNA, 136 bp, Homo sapiens
tttttttttttttttttcaaccagcccctctttgttttaaaaagaaaattaagctacccactttctgtttacttacatagaattccactatttaggctttagaaaatagcccttctgtcgtcttctcgcagccgta

SEQ ID NO: 4945 - DNA, 464 bp, Homo sapiens; identical to SEQ ID NO: 3886

SEQ ID NO: 4946 - DNA, 360 bp, Homo sapiens; identical to SEQ ID NO: 3887

SEQ ID NO: 4947 - DNA, 391 bp, Homo sapiens
aatttgacttgtaccaggattataaaacatatagaaaatgattccttccgctgtgcatagagtttatcatcgtctttcttctgcttgtcacatccttgctttttagaccatttatcacccatcactctgacttttcagaccctcataatccacatgatacttatccttttgattaaaacaacttaatggccttttcacgaataattaatctgctgtctttactttcagctccaggcttttaactttaatgttgagttatccagcctgtgttgcctttcaaagtttcactccccttagccttttcccctcaaaggtttaatacttctttagaaacttcaatagttgctatacaaaggttttaaaaaatgcttctgagttactctcacatccc

SEQ ID NO: 4948 - DNA, 412 bp, Homo sapiens
gcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgtgcgcgcgc

SEQ ID NO: 4949 - DNA, 51 bp, Homo sapiens
ggcttcgcctagaagaggaagcccgaaagcaggaagaagaaaggaagcgcc

SEQ ID NO: 4950 - DNA, 591 bp, Homo sapiens; identical to SEQ ID NO: 3890

SEQ ID NO: 4951 - DNA, 615 bp, Homo sapiens
gaatttggccctcgaggccaagaattcggcacgaggaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacaca

SEQ ID NO: 4952 - DNA, 617 bp, Homo sapiens
gaatttggccctcgaggccaagaattcggcacgaggcgcccactcctgcacccctgttgctggacctgggtatccctgtgggccagcggtcagccaagagcccccgacgtgaggaggagccccgcggaggcactgtctcacccccaccggggacatcacgctctgctcctagcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagc

SEQ ID NO: 4953 - DNA, 651 bp, Homo sapiens
ggaatttggccctcgaggccaagaattcggcacgagggggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagct

SEQ ID NO: 4954 - DNA, 61 bp, Homo sapiens
ccaggttcattcccagtgtttacctggaatattgctagaatttacttttgtcataatgcaa

SEQ ID NO: 4955 - DNA, 510 bp, Homo sapiens
  misc_feature 465: n = A,T,C or G
cataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttcctttttttgccaggagattcagaccttgatcagctaacaagaatatttgaaactttggggcacaccaactgaggaacagnggccggacatgtgtaggcctccagattatgtgacatttaagagtt

SEQ ID NO: 4956 - DNA, 578 bp, Homo sapiens
tcggcacgaggcactgttgtattttggggtcgtgtatggagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccccctaaaactgatgaattatt

SEQ ID NO: 4957 - DNA, 557 bp, Homo sapiens; identical to SEQ ID NO: 992

SEQ ID NO: 4958 - DNA, 470 bp, Homo sapiens
gcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttg

SEQ ID NO: 4959 - DNA, 342 bp, Homo sapiens
aggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgaga

SEQ ID NO: 4960 - DNA, 428 bp, Homo sapiens; identical to SEQ ID NO: 3894

SEQ ID NO: 4961 - DNA, 467 bp, Homo sapiens
gtccaatatggcggcgcccagtggcggtgtgaactgtgaggagttcgccgagttccaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagagattcttttttttttttttt

SEQ ID NO: 4962 - DNA, 508 bp, Homo sapiens; identical to SEQ ID NO: 3895

SEQ ID NO: 4963 - DNA, 119 bp, Homo sapiens
attaatcccctggcccaacccgtcatctactctaccatctttgcaggcacactcatcacagcgctaagctcgcactgattttttacctgagtaggcctagaaataaacatgctagcttt

SEQ ID NO: 4964 - DNA, 415 bp, Homo sapiens
ggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttacgagggcagtgagaccacccagccaaattgcttctcaaccctagacaaagcctttggccaagagggaggtgctgttagttgggcagcccttctgggtttcagagaccggtgttggctctagactggtctcatc

SEQ ID NO: 4965 - DNA, 458 bp, Homo sapiens
cagcattctgactgggaaccaggactcccggtcggagtagctcttcactcctcagcgcgacgtcgtgtcgagttcccaaaaagctccgcaggggctgtagggaggcatacaagagttaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttct

SEQ ID NO: 4966 - DNA, 423 bp, Homo sapiens
gagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgc

SEQ ID NO: 4967 - DNA, 96 bp, Homo sapiens
caccattcttcctgggaaccgcactgctgccttgaaagccttcctgctctccgaactgtgcctccttggggcctgggccgccttggcaggaggggg

SEQ ID NO: 4968 - DNA, 135 bp, Homo sapiens
accacaaaaaccaaactgccccaatgaccttagccccattgctccattcactcccaggtgagaattcaggcaaacgtccacaaaggtcacaggcagcgtacatacggttctgttataccccatatattacccctt

SEQ ID NO: 4969 - DNA, 62 bp, Homo sapiens; identical to SEQ ID NO: 3900

SEQ ID NO: 4970 - DNA, 423 bp, Homo sapiens
cctcatccattccaaaatatgcccggtgctatccgcccagctgctcctagaccaccatgtagtactatgagaccagcttcttcacaggttccacgagtcatgtcaacacagcgtgttgctaacacatcaacacagacaatgggtccacgtcctgcagctgcagccgctgcagctactcctgctgtccgcaccgatccacagtataaatatgctgcaggagttcgcaatcctcagcagcatcttaatgcacagccacaagttacaatgcaacagcctgctgttcatgtacaaggtcaggaaccttggactgcttccatgttggcatctgcccctcctgaagagcaaaagcaaatgttgggagaacggctgtttcctcttattcaagccatgcaccctactcttgctggtaaaatcactggcatg

SEQ ID NO: 4971 - DNA, 411 bp, Homo sapiens; identical to SEQ ID NO: 3901

SEQ ID NO: 4972 - DNA, 382 bp, Homo sapiens
agggctcagtagtcagtttgaagcgggtatgcacaaagatagctggcttctgggtaagtttgcaagtgtgaattttcattttgtttggaggcatagaaaagttatgtaggctgggggcggtggctcacacaaccccagcactttgggaggctgaggcggtagatcacctgaggtcaagagctggagaccagcctggccaacatggtgaaatcttgtctctactaaaaatacaaaaattgggcatggtggcaggcgcctgtagttccagctactcgggaggctgaagcaggacaatcgcttgaacccagaacgcagaggttgcagtgagccgagatggcgccattgcacccccacctgggcaacagaacaaaaactccatctc

SEQ ID NO: 4973 - DNA, 83 bp, Homo sapiens
tggacagaatcgccggacaggtggcaactgccaacaagaagcattagaacaaaccatgctgggttaataaattgcctcattcc

SEQ ID NO: 4974 - DNA, 279 bp, Homo sapiens
gggactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgact

SEQ ID NO: 4975 - DNA, 310 bp, Homo sapiens
gctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagg

SEQ ID NO: 4976 - DNA, 215 bp, Homo sapiens; identical to SEQ ID NO: 3902

SEQ ID NO: 4977 - DNA, 280 bp, Homo sapiens
ctgcttccgcatcttctgttcacgttcctgtttctgctcttggtgcaggatctgcagctactgctgcatcagaagaaatggttagtacagtttatacaggtcccaccttatgaaaagggcggccaggcccagtggctcacacctgtaatcccagcactttgggaggccgaggcaggtggatcacgaggtcaggagatcgagaccatcctggctaacacggtgaaaccccgtctctactaaaaatacgaaaaattagccgggtgtggtggcagccgcctgt

SEQ ID NO: 4978 - DNA, 390 bp, Homo sapiens
gagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcaatgtgaagagaaatcaagagatgctaag

SEQ ID NO: 4979 - DNA, 422 bp, Homo sapiens; identical to SEQ ID NO: 3904

SEQ ID NO: 4980 - DNA, 430 bp, Homo sapiens
gggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaagtgtgtacagcgtgctgtagtggaagttttgtatcat

SEQ ID NO: 4981 - DNA, 363 bp, Homo sapiens
gagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcattttattcaagctggcctgctgtctgccttgggctccctgatattgatgatttggctgatggcaacacctcatagccctgaaactgaacagaaaagactgggacttcttgctggatttgcat

SEQ ID NO: 4982 - DNA, 72 bp, Homo sapiens
gggccttttcacaagatggcgccgaaagcgaagaaggaagctcctgcccctcctaaagctgaagccaaagcg

SEQ ID NO: 4983 - DNA, 432 bp, Homo sapiens
attaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagaggttacccaaggcacccctctgacatccggcctgcttcttttcacatgacaaaaactagcccccatctcaatcatataccaa

SEQ ID NO: 4984 - DNA, 300 bp, Homo sapiens
ggtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgttaagtttaaagttcgatgcagcagatacctttacaccctggtcatcactgacaaagagaaggcagagaaactgaagcagtccctgccccccggtttggcagtgaaggaactgaaatgaaccagacacactg

SEQ ID NO: 4985 - DNA, 330 bp, Homo sapiens
gcttttttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactca

SEQ ID NO: 4986 - DNA, 330 bp, Homo sapiens
gagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcact

SEQ ID NO: 4987 - DNA, 290 bp, Homo sapiens
gagctcacgctggctcacacagctctagggggctgctcctctaactcacagagggttttgtgaggctctgtgggccacaacagacctgcatatctgagcaaaaatagcaaaagcctctctcaacccactgggctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcaccc

SEQ ID NO: 4988 - DNA, 257 bp, Homo sapiens
gagaatatattcataatcaagctgatacttcatgattaaattatttttgttgcttaaaagtcgtattagacagactaaatcattttttttttatggttcaaaaaagatgaataccaacgtttttgcaggttctgctgtgaaaagggggttgaattttttgggggggtaattttgatcataaatgcgttaatactcataaaccagattaatccttttatttgcttcctccaactatttaaaggggggcaaaaacactt

SEQ ID NO: 4989 - DNA, 365 bp, Homo sapiens
ggttttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacaaggacttgctgtgcttgctaaggaaagaccaccaaatcccattgaatttctagcatcttatctttt

SEQ ID NO: 4990 - DNA, 157 bp, Homo sapiens
ttgtgccgccgctgtggctctaaggcctaccaccttcagaagtcgacctgtggcaaatgtggctaccctgcccagcgcaagagaaagtattactggagtgccaaggcttaaagacgaaataccaccggaactggtcgaatgaggcacctaaaaattg

SEQ ID NO: 4991 - DNA, 76 bp, Homo sapiens
gctctttacggtgtggagtctggagaccacctgcagaaatggcacctccaaaggggaagggaaacaaggaagaaca

SEQ ID NO: 4992 - DNA, 264 bp, Homo sapiens
tatcccaatcttcaaactcaaatttgaacgcccactggccatctctacttggatatttatttctttttttgtttgtttgttttctttttttgtttgtttttgagacggagtcttgctctttcgcccaagccggagtgcaatggcgctatcttggttcactgcaagctccgcctcccaagttcacgccattctcctgcctcaacctcccgagtagctgggactacaggcgcccattaccgcgcccggctaattttttgtattttt

SEQ ID NO: 4993 - DNA, 357 bp, Homo sapiens
  misc_feature 357: n = A,T,C or G
gagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattgtggcctagctatggcttgccatgactccttcctcaaggctggcccttn

SEQ ID NO: 4994 - DNA, 101 bp, Homo sapiens
gtcaaaaagctccagcccagaaagcacctgctccaaaggcatctggcaagaaagcataagtggcaatcataaaaagtaataaaggttctttttgacctgct

SEQ ID NO: 4995 - DNA, 494 bp, Homo sapiens; identical to SEQ ID NO: 3914

SEQ ID NO: 4996 - DNA, 493 bp, Homo sapiens
gagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaagagctggactaaccaggagagaagtctagttggttccctacaggtgcactggaaacactccagcagggaccttctgggatctggggagcactgctgccaattattaacagcagtcagggccagtaaagacctatcctgcctaaacaccactgcatccctggtaatctatctatgacccacttctagttggtactgatgtcctgccaagaaccttaaccaacagttgactatattctccgaaaccagaag

SEQ ID NO: 4997 - DNA, 411 bp, Homo sapiens
gcggccgctcacctctcctccgtggagaagacgaacttcctaagcttcaggtcccccagcacgatggctgactggtggcagtgggcgacggcggagacaatctgcttgaagagccgggcggcttcctcttcccgcagcctcttccggcttcgcacataggagtgcatgtccccaaagtccttctcaaagaagacataggccttggtttccccaaggatcacttccacaatgccagtaatgttgctgtgcgatggcagctggatgtaaggcctgattttgtcctggtagtgtttaatgggaaacacctgtagagagaaggggggcccgtttagggggctagaaaagcaaaggcagcctcgcaaacccctgagggagctgaacagaagttctcaacctgtgggcttaggatgt

SEQ ID NO: 4998 - DNA, 181 bp, Homo sapiens
ccacagaagagaggctttcgacgaaacatctctgcaaagatacagccaacaatccacatgtccacaagtgttgcatatgtggactggcaaaaacttcgggagctggtaccagagtgtaaaaaccacgggtgtaagtgccatctgttagccgtagatatctggcaggccaagtcagccagtt

SEQ ID NO: 4999 - DNA, 436 bp, Homo sapiens
gggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagacgctttacaagaggctgctgctctacttcagagctctggcgattggaaccctcttactcaagcgcctcttccagctcatcccgggagcagtttggtttcagcctctggaagat

SEQ ID NO: 5000 - DNA, 589 bp, Homo sapiens
gagagttttagaggaatataaggtgtgaatgaaaattccaataacataatgtacaaaaatgttgtcacatacagaagagcaaaaatctacgtattggggactattgctgtgggaagaagggcctgatcttcatactcatcttcctcattgagtaccatgaccccttccaattcatccatactacaccatcatctgtgccatgctttgccatgtcccaggtgtactgtccaccccagtagtatctgccgtttggattggctgcatgacatctattataccaccatccaccaccgtcttctttagaacactgttttctgggatctgatgttaaccagccgtcattgtctctgtcatacgtgctgaagaacatgccgttgtgaatggtcatggtcctgttttctcccatcagctgagatgctccatccatgagggcattaccggctgttcctctgtatttgttcactgagatctggtatttgttggcttcattctgtacagtgaatcctccatagtgagcctttactttgctccctttcagtcctccattctatcaaagttctgtggtcccatcctgtaagctggttatttt

SEQ ID NO: 5001 - DNA, 534 bp, Homo sapiens
cactgaaaactttttattgctcttttggatagaaacgggaatttatttgccaggaaggatgatcccatcatacttctgctggaaccagcgcatggcctcctctttgctgattctgtgtttggccccaatgcagcctgtcctgcgcttcttgtctgcgatgctgaaacctggcctacccagcaccacatagaagtccaggccgtagataccaatgcttgggtcatatttgatacccagatcgatgtgttcctggatcccaaaaccaaagtttccagtatctgagaagttgttttttcttaactcaaaatcccgaacctttagacccttctccaagatttcttctgccttggcccctcgaactgtgcagtggacagcaatcttttcatttctccggatgccaaaggatctgacagtgtatctagctttggaaaacacaggggtctgccctgtgagctgctccaacaccttggctgctcgcgtcagtctgtctccactctccccaacacagatgttgagacagagtttgcggatgcg

SEQ ID NO: 5002 - DNA, 372 bp, Homo sapiens
cagtgatcagaatagcaataaaccaatccttcgctttctttaaagaatataaaattcaattctgtgttttaaatattcaatatggaacttccagaaatatgtaacaatccatcgtaggaaaatttcaccataggcttatgctcaggagggctgcataacccctactcaccatctggtagatacataatcagtgtatggtggctgtgaccttaattctcttgcaagtccaaaatcagcaattttcacgagctctggacccatacaaagcaagttttctggtttcatgtccctatgaaaaaagccttgatgatatacggagaaaaaaaaatacagtaaatcattacgtttaaacatagctttatttgatttata

SEQ ID NO: 5003 - DNA, 830 bp, Homo sapiens; identical to SEQ ID NO: 1000
  misc_feature 586, 595, 620, 664, 666, 678, 699, 704: n = A,T,C or G

SEQ ID NO: 5004 - DNA, 580 bp, Homo sapiens
  misc_feature 466, 503, 545: n = A,T,C or G
atctcgaaatagttgaggccatacatttccaggtcctgagcaatcttcaggtattccaacatagcattatctttgagcatcccacggtgttccgcatgccacacctggatccggtcctcccactggtccctggtaagtttgtgctggtccatcactctttgagggatcagccgctcagagctgaggtacccagacttgtgcacttctttgttgtagtccccaaacttggcctgcacagcgtaggaccccaagagcacggcagtctcaggggggcagtagatctcatcgctaaggattccttccttcacttggaggaagaaaagtttctgggtgatgtcctggatgagctcctcagccacatcttcagggtagaacttggcccggaacttgaactggaggggattctccttcctgacctcctgggcagacaccttcttatccagcttcagccaggtaggaaatcctntattatccacatagtggaggccaaagtaccacacttnccggaggccgatagtctttaccacctgatcaataagctgttntccagtgtatttggctggattgaaactccagctct

SEQ ID NO: 5005 - DNA, 596 bp, Homo sapiens
aagcagtaaaaccaaatgtccttagaaattcctttagtgctcagctgtccatgaaaacaggataagcggcttcctccgtctgtgctcagcagggcagggtggaggcgctgcgctcaggccaggaggacctctaatcaggacggggtggggcggggctctgagctggggaagcggctccagcgttgctactttagggcgtccaggtgggtgcagacctgggagaagacactgtccacggagccctcagcgttgaccttgcgcacaatgccacgtttctcatagaaggcgatgacgggttctgtggccttgtaataggtctccagccgctttttgatggtctcctcattgtcgtccacacgcccgctggtctctccacgtttcaagagccgctgggtcatggtctcagggcctgcgtccacatacagcagcagtgtgggctgtccaatccgtcgctcaaactcttctccttgctgcacctcccgcgggtagccatcaatcaggaagcctttggaagtattgactttggccaccatggcatcccggagcatgtccaacactgtctccagtggaaccagctgccccttctccatgatttc

SEQ ID NO: 5006 - DNA, 508 bp, Homo sapiens
ggcatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaataggaccaggtgaaacatgtagtcattttttaaaaacatgtacttggtctttt

SEQ ID NO: 5007 - DNA, 446 bp, Homo sapiens
aattctcctgcttcagcctcccaagtagctgggactacaggcgcccaccaccacacccagctgatttctgtatttttagtagagacagggtttcaccatgttggccaggatggtcttgatctcttgacctcatgatctgcccccgtcggcctcccaaaatactgggattacaggcatgagccaccacgcccagcccccagtgtgttaacaaatgatgcagaccacagtaaaggttcccatcaaaaatctgcctacaagagcgctactgatttccttgagtctataaaaagattatttcactttctaattttctacaataaaaagatcatgatactaatgtaaatttttttaattccaaattctaatgcttcatcaaaatataattttattggtgtttcacacttgtaatcccagcactttgggaggctgaggcgggtggatcacct

SEQ ID NO: 5008 - DNA, 506 bp, Homo sapiens; identical to SEQ ID NO: 3919

SEQ ID NO: 5009 - DNA, 404 bp, Homo sapiens
ggccagactgagcccaggttgatttcatgcggacacgaatagactccacagcacctccaggagcccagacaccggcggccagaagcaaggctaggagctgctgcagccatgtcggccctcagcctcctcattctgggcctgctcacggctgtgccacctgccagctgtcagcacggcctggggaaccttcagccctggatgcagggccttatcgcggtggccgtgttcctggtcctcggtgcaatcgcctttgcagtcaaccacttctggtgccaggaggagccggagcctgcacacatgatcctgaccgtcagaaacaatgcagatggagtcctggtgggaacagatggaaggtactcttacatggcggccagtttcaggtacagtgagcatgataatgccta

SEQ ID NO: 5010 - DNA, 509 bp, Homo sapiens
aggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgct

SEQ ID NO: 5011 - DNA, 317 bp, Homo sapiens
  misc_feature 317: n = A,T,C or G
tacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttan

SEQ ID NO: 5012 - DNA, 357 bp, Homo sapiens
agggattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctacatggtggggacatcatcaa

SEQ ID NO: 5013 - DNA, 352 bp, Homo sapiens; identical to SEQ ID NO: 3924
  misc_feature 40, 51: n = A,T,C or G

SEQ ID NO: 5014 - DNA, 515 bp, Homo sapiens
gagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgttt

SEQ ID NO: 5015 - DNA, 480 bp, Homo sapiens; identical to SEQ ID NO: 3928

SEQ ID NO: 5016 - DNA, 481 bp, Homo sapiens; identical to SEQ ID NO: 3929

SEQ ID NO: 5017 - DNA, 458 bp, Homo sapiens; identical to SEQ ID NO: 3930

SEQ ID NO: 5018 - DNA, 52 bp, Homo sapiens
ttatgtcagaaaaacacacacacacacacacacacacacacacacacacaaa

SEQ ID NO: 5019 - DNA, 368 bp, Homo sapiens
cataactgaattagataatcctatgtgctttatactattttttatactgttattctacaaaaacttgtgatcaatttatgtagagaccaggctgggagcggttgctcacgcctgtaatcctagcactttgggaggctgaggcaggcagatcactaggtcaggagatcgagaccatcctggctaacacagtgaaaccccatctctactaaaaatacaaaaaattagctgggcgtggtggcgggcgcctgtagtcccagctacttgggaggctgaggcagtagaacggcgtgaacccgggaggtggagcttgcagtgagccaagatcgtgccactgcactccagcctgggcgacagcgacactccatctg

SEQ ID NO: 5020 - DNA, 323 bp, Homo sapiens
gcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctgcccgtgggaggaatcgttaggctgaggccgcagtggtcgccgtagccgagaagcgagagaagctggcgaacggcggggagggaatggaggaggcgaccgttgttatcgaacattgcactagctgacgcgtctatgggcgcaacgccgcggtcctgagccatgcgctgcgcctggaggcccc

SEQ ID NO: 5021 - DNA, 265 bp, Homo sapiens
gaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtt

SEQ ID NO: 5022 - DNA, 369 bp, Homo sapiens; identical to SEQ ID NO: 3934

SEQ ID NO: 5023 - DNA, 111 bp, Homo sapiens; identical to SEQ ID NO: 3936

SEQ ID NO: 5024 - DNA, 381 bp, Homo sapiens
  misc_feature 337: n = A,T,C or G
gcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtanaggtgaacccgacgaaaccccggaagggcagcttccaggggacc

SEQ ID NO: 5025 - DNA, 459 bp, Homo sapiens; identical to SEQ ID NO: 1004

SEQ ID NO: 5026 - DNA, 77 bp, Homo sapiens; identical to SEQ ID NO: 3949

SEQ ID NO: 5027 - DNA, 219 bp, Homo sapiens; identical to SEQ ID NO: 1009

SEQ ID NO: 5028 - DNA, 191 bp, Homo sapiens
taaagcttacattttcacagggggggctcttaaacacattccacaaatgccattaagaatttattttgctttaagccagtcatggtggctcatgcctgtaatcccagcaatttgggaggctgaggcaagaactgcttgagcccacgagtttgagactagcctgggcaacatagaaagaccctggctctacc

SEQ ID NO: 5029 - DNA, 173 bp, Homo sapiens
agggagtggtcatataaatgatgtccggcatgcaaaatctggaggtacagcacttcacgttgcagctgctaaaggctataccgaagttttaaaacttttaatacaggccggctatgatgttaatattaaagactatgatgggtggacacctcttcatgctgcagctcattggg

SEQ ID NO: 5030 - DNA, 407 bp, Homo sapiens
  misc_feature 159: n = A,T,C or G
cttttaaaaatctaatatgaggccaggcgcggtggctcacgcctgtaatcccagcactttgggaggctgaggtgggtagatcacgaggtcaggagatcaagaccatcctggccaacatggtgaaaccctgtctctactaaaaatacaaaaattagccgngtgtggcggcgcatgcctgtagtcccagctactcaggaggctgaggcaagagaatttcttgaacccgggaggaggaggctgcagtgagccgagatcattccattgcactccagcctggcgacagagtgagactctgtctcaaaaaaccaacaaaccaaaaaaaaacaaaaacaaaccaacaaaccaatctaatatgaaattctaggctgggcaccgtgactcatgcctatgatcccagcactgtggga

SEQ ID NO: 5031 - DNA, 357 bp, Homo sapiens
  misc_feature 349, 357: n = A,T,C or G
ggagtatggttgcaaagctgaaacttaaaggaattgacggaagggcaccaccaggagtggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggngctgcacn

SEQ ID NO: 5032 - DNA, 51 bp, Homo sapiens; identical to SEQ ID NO: 3955

SEQ ID NO: 5033 - DNA, 94 bp, Homo sapiens; identical to SEQ ID NO: 3956

SEQ ID NO: 5034 - DNA, 197 bp, Homo sapiens
gggtaacacagttaatttaccaactgatacagataatagaatatattcataatcaagctgatacttcatgattaaagggatttttgttttttaaaagtcgtattggataagactaaatcattcttttttatggtttaaaaaagatgaatacaaacgtttttgcaggttctgctgtgaaatgtggtttgatttttttg

SEQ ID NO: 5035 - DNA, 130 bp, Homo sapiens
taataaaataaaaattaaacactttgggaggccgaggcgggtggatcatgaggtcaggagatcgagaccatcctggctaacaaggggaaaccccgtctctactaaaaatacaaaaaattaaccgggcgtg

SEQ ID NO: 5036 - DNA, 322 bp, Homo sapiens
gagacacactctgccccaaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggtaatgagaaaatggccatgcagaacctaaatgaccgtctagcgagctacctaaaaaaggtg

SEQ ID NO: 5037 - DNA, 74 bp, Homo sapiens; identical to SEQ ID NO: 3958

SEQ ID NO: 5038 - DNA, 468 bp, Homo sapiens; identical to SEQ ID NO: 3961

SEQ ID NO: 5039 - DNA, 336 bp, Homo sapiens; identical to SEQ ID NO: 3963

SEQ ID NO: 5040 - DNA, 459 bp, Homo sapiens; identical to SEQ ID NO: 3967

SEQ ID NO: 5041 - DNA, 399 bp, Homo sapiens
tgttccggattgagggcctcgcgccgaagctggacccggaggagatgaaacggaagatgcgcgaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacggtagcgggtagcaaggaggctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgctt

SEQ ID NO: 5042 - DNA, 344 bp, Homo sapiens
gcactcaagtgaggagacaggccgtgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgct

SEQ ID NO: 5043 - DNA, 444 bp, Homo sapiens; identical to SEQ ID NO: 3969

SEQ ID NO: 5044 - DNA, 190 bp, Homo sapiens
gggtgggaagccagagccgcctgccatgccccagccagtccccacagcataacagggtctccttggcagctgtattctggagtctggatgttgctctctaaagacctttaataaaattttgtacaaaaaaaaaaaaaaaaaaaaaaaaggttttttttttttccccccaattttaaaaaatttccccccc

SEQ ID NO: 5045 - DNA, 456 bp, Homo sapiens; identical to SEQ ID NO: 3971

SEQ ID NO: 5046 - DNA, 439 bp, Homo sapiens; identical to SEQ ID NO: 3975

SEQ ID NO: 5047 - DNA, 546 bp, Homo sapiens
cggggcgaagtctgtgtctcacgagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagcacactcttgattacccttgttgtaactgtggagttgtggagtaagctggttttagacctcaag

SEQ ID NO: 5048 - DNA, 512 bp, Homo sapiens
ctccatgctaaactttccacgtcttctatctaaaaggtccccaaaggcaccactatttggtgtgaagattttgagcagcacttagattgctgattttctgggaggttgcatgcctgtaagttgctgctgactctccttttaacccactgaactcccccaagagcctccacgccaaagtttcaccgttttctaaaaacatcttaagtccctgtagaattacgggtgtggaactggtgggctgcaaattcctataagtactggaggtttgaataagttgctaagaaacaagacaacaaggagaaagaaaacacagaaggttacacctgcaagagaaaaaaaaatattagaaaccaagtacctggaataaagattccatttttggagcagctattctgcagatacttagcacagctcttttaaagcaagcacagcttcactttcccccaagcccagtgttgcaacacagatacatcacttcatccctttggtttgaggtagacttcttagggcaa

SEQ ID NO: 5049 - DNA, 689 bp, Homo sapiens; identical to SEQ ID NO: 1018

SEQ ID NO: 5050 - DNA, 559 bp, Homo sapiens
gtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagacggagaacgaagagctctgaaattaccaaatcttgtggacatggcagcacaggtggctgcaggaatggcttacatcgagcgcatgaattatatccatagagatctgcgatcagccaacattct

SEQ ID NO: 5051 - DNA, 625 bp, Homo sapiens
ctcgtgggcctcctcagcccacacaacgcggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacagacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaata

SEQ ID NO: 5052 - DNA, 452 bp, Homo sapiens; identical to SEQ ID NO: 3979

SEQ ID NO: 5053 - DNA, 131 bp, Homo sapiens; identical to SEQ ID NO: 3981

SEQ ID NO: 5054 - DNA, 453 bp, Homo sapiens; identical to SEQ ID NO: 3982

SEQ ID NO: 5055 - DNA, 434 bp, Homo sapiens
atcattaatttttctttttttcaaggttcattttcaacaattaaagggctcagcaagcatatcctttttggggctgggcgcggtgactcacacctgtaatcccagcactttgggaggccgaggtgggtggatcacttgaggtcaggagtatgagaccagcctggccaacatggcgaaacctcgtctctactaaaaatacaaaaatgagctgggtgtgatagcgcacctgtaatgccagctactcaggaggctgaggtaggagaatcacttgaacctgggaggcggaggttgcagggagccgagatcgtgccactgcactccattcagcctgggcaacaaaaggagactctgtctcaaaaaaaacaacaaaggccaggcgtggtggctcattcctgtaatcccagcactttgggaggctgaggcaggtgaatcac

SEQ ID NO: 5056 - DNA, 492 bp, Homo sapiens; identical to SEQ ID NO: 3983

SEQ ID NO: 5057 - DNA, 358 bp, Homo sapiens
gtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacgggcatgagccaccgcacctggccttccctgcttcctctctagaatccaattagggatgtttgttactactcatattgattaaaacagttaacaaactttttttctttttaaaatgtgagatcagtgaactctg

SEQ ID NO: 5058 - DNA, 496 bp, Homo sapiens
gagaacagccacccctctctcgggcactgctgccatgaatgccttcctgctcttcgcactgtgcctccttggggcctgggccgccttggcaggaggggtcaccgtgcaggatggaaatttctccttttctctggagtcagtgaagaagctcaaagacctccaggagccccaggagcccagggttgggaaactcaggaactttgcacccatccctggtgaacctgtggttcccatcctctgtagcaacccgaactttccagaagaactcaagcctctctgcaaggagcccaatgcccaggagatacttcagaggctggaggaaatcgctgaggacccgggcacatgtgaaatctgtgcctacgctgcctgtaccggatgctaggggggcttgcccactgcctgcctcccctccgcagcagggaagctcttttctcctgcagaaagggccacccatgatactccactcccagcagctcaacctaccctggtccagtcg

SEQ ID NO: 5059 - DNA, 305 bp, Homo sapiens; identical to SEQ ID NO: 3984

SEQ ID NO: 5060 - DNA, 280 bp, Homo sapiens
cgcattctagctgggaaccggcatttttcttggaaaccaataattatctgttataacaaacccacagccaatataatactgaatgggcaaaactggttgattccttttgtaaactggcacaagacaaggatgccctctcttaccactcctattcaacatagttttagaagttcaggccagggcaatcaggcaagataaaaacataaagcgtattcaaataggaagagaggaagtcaaattgtccctgtttgcagatgacatgattgtatatttagaaatc

SEQ ID NO: 5061 - DNA, 325 bp, Homo sapiens
ccaatcccatgggcccacagaggctcttagaaaaacacagcatggcggccgggcatggtggctcatgcctgtaatcccagcattttgggaggccgaggcgggtggatcacgaggtcaggagatggagaccatcctggctaacacggtgaaaccccgtctctactaaaaatacaaaaattagccaggcatggtggtgggcacctgtagtcccagctaattgggaggctgaggcaggaaatggcgtgaaccctggaggcggagcttgcagtgagctgagatggcgccactgtactccagcctgggcgacagggcaagactccatctc

SEQ ID NO: 5062 - DNA, 307 bp, Homo sapiens
attggctagatgatttttaaaattcatttggaaacacaaatgtcaaaaaaataaacaaaataatcttgaaaagaggccgggtgcggtggctgatgcctgtaatcccagcacttcgggaggctgaggcaggtgaatcacctgaggtcaggagttcaagaccagcctggccaacatggtgaaaccccatctctactaaaaacacaaaaattagccgggcgtggtggccggcacctgtaatccagctacttgggaggctgaggcaggagaattgcttgaaccctggaggcagaggttgcagtgagccaaa

SEQ ID NO: 5063 - DNA, 114 bp, Homo sapiens
gcgagaagaccgatcagatagggcggggaggtaatagatgagcagctatacagtgactaggaatagaggactagtgtgaaagatcctgataaggaaaagagtgctgaactttac

SEQ ID NO: 5064 - DNA, 84 bp, Homo sapiens
aaggggcagagagtaaaaaacatgacctggtagaaggaagagaggctaaggaaactgggtggggaggatcaattagagaggagg

SEQ ID NO: 5065 - DNA, 379 bp, Homo sapiens
ttactgaccactgcatggcaggctctatgctgagcactgtgaatacagaagtgcatcttgatatggggattccaactgcatggagctcacaccgtccaacccagattgacgtacataataggtccttgactaaaaaaatctcagaggctgccaggcctagtggctcacacctataatcccagcactttgggaggccgaggcaggcagatcacctgaggtcgggagttcaagaccagtctgaccaacatggagaaacctcatctctactaaaaatacaaaattagctgggtgtggtggcgcatgcctgtaaccaagctactcgggaggctgaggcaggagaattgcttgaacgcaggagaatcgcttgaacccaggaggc

SEQ ID NO: 5066 - DNA, 96 bp, Homo sapiens
ggaagaagaacgacaggagagagaagaggaacaacgtctcaaacggcttgaagaattagaagccaagcgtaaagaagaggatcgattggagcagag

SEQ ID NO: 5067 - DNA, 206 bp, Homo sapiens
gcggggcccgaagcgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggacc

SEQ ID NO: 5068 - DNA, 319 bp, Homo sapiens
atggagtctcactctattgcccaagctggactgcagtggcacgatcttggctcaccacaacctctgcctcccaggttcaagcaattctcttgcctcaacctcccgagttgctgggactacaggcatgcgccaccatgctgggctaattcttgtattcttagcagagacggggtttcactatcttggacaggctggtctctaactcctgaccttgtgatccacctgcctcatcctcccaaattactgggattacaggcgtgagccaccgcgctcggcctgacttcaaattttttaagctcactgaaagcataatataaac

SEQ ID NO: 5069 - DNA, 148 bp, Homo sapiens
ctgaactgacaattaacagcccaatatgtacaatcaaccaacaagtcattattaccctcactgtcgacccatcacaggcatgctcataaagaaaggttaaaaaaagtaaaaggaactcggcaaatcttaccccgcctgtttaccaaaa

SEQ ID NO: 5070 - DNA, 132 bp, Homo sapiens
gctaatgaatactaagctctgttcatgcaaactcagcctttgtgctcgaatgctcatcttaggatgggcatctgctcacaccctaaaaagtaggctgaagccgggcacagtggcttacacctgtaataccag

SEQ ID NO: 5071 - DNA, 139 bp, Homo sapiens
ttccctagtagctgggattacaggctcccaccaccatgccaggctaatatattttttttttggaaacaaaattttgttttgtcaaccaagttggggtgcggaggcataacctcagttcactgaaacctccttatcccgg

SEQ ID NO: 5072 - DNA, 171 bp, Homo sapiens
aaataaacgtctttatcgacgatcccttctttatagagcgatgtgtatttatttgtataacacaaacacctacatctatcatacagaagtctatttccatacaaccgatacgtatttaccatacgcaagagtattcaatgcagagatacacgttgtcggtgtttgcatata

SEQ ID NO: 5073 - DNA, 437 bp, Homo sapiens; identical to SEQ ID NO: 3990

SEQ ID NO: 5074 - DNA, 132 bp, Homo sapiens
acagaagggggagataaggcaaagaggcactttgtggatttctccatactgagcagctctgtgattcattatctgttctagagagcagcacacgcagttccagcaaaaaaaaaaaaaaaaaaaaggtttttt

SEQ ID NO: 5075 - DNA, 245 bp, Homo sapiens
tctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgcattttcaccgagcttatatttggtgtgttttttgtcttttctttatgattatcaataaaatgc

SEQ ID NO: 5076 - DNA, 491 bp, Homo sapiens; identical to SEQ ID NO: 3993

SEQ ID NO: 5077 - DNA, 361 bp, Homo sapiens
gagttcacggatacctcttatgaggagaaacggtacacgtgcggggaagctcctgactatgatcgaagccaatggctggatgtgaaattcaagctagacctggactttcccaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttc

SEQ ID NO: 5078 - DNA, 508 bp, Homo sapiens
acagaagggattctgtatttgtctcccatgtcttgctcctctcctggagaattctgtcttctctttggccatctcaaattgagaacctaaactattcctgcagaactgcctggttggcgtccacaagtaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtata

SEQ ID NO: 5079 - DNA, 324 bp, Homo sapiens
atcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattc

SEQ ID NO: 5080 - DNA, 364 bp, Homo sapiens
gcacttccagatcgagaagctcttgaacaaacctcgactgaaatataaaccagtgactaaccaggttgagtgtcacccatacctcacgcaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaa

SEQ ID NO: 5081 - DNA, 139 bp, Homo sapiens
cccggggccggaccccgagggctcgatccgcatctgcagcatgaggttctgcccatttgctgagaggacgcgtctagtcctgaaggccaagggaatcatgcatgaagccatcaatatcaacctgaaaaataggcctgag

SEQ ID NO: 5082 - DNA, 319 bp, Homo sapiens; identical to SEQ ID NO: 3998

SEQ ID NO: 5083 - DNA, 338 bp, Homo sapiens
atacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttac

SEQ ID NO: 5084 - DNA, 341 bp, Homo sapiens
gcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcatt

SEQ ID NO: 5085 - DNA, 346 bp, Homo sapiens
  misc_feature 293, 346: n = A,T,C or G
gccccactgagcggtgtcctgagccgattacagctaggtagtggagcgccgctgcttacctgggtgcaggagacagccggagtcgctgggggagctccgcgccgccggacgcccgtgaccatgtggagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggngaccttccactgaagctacggagtttacagaaagcaattttgcaatcttgggn

SEQ ID NO: 5086 - DNA, 397 bp, Homo sapiens
ggggggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgca

SEQ ID NO: 5087 - DNA, 327 bp, Homo sapiens; identical to SEQ ID NO: 4001

SEQ ID NO: 5088 - DNA, 341 bp, Homo sapiens
ggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcagattacccactcccgacccggggaggtagtgacgaaaaaaagcgcgcaaaattaacccaatcacgagccggcgtttttttgtcgaaatccaacttggaaaaaatcctttggggggttggccccccccccgcttgaaggggggggaaaaaacgctttttttgggaaaattggacccgcttttgttt

SEQ ID NO: 5089 - DNA, 58 bp, Homo sapiens
ctctgctcaaaatttctctttcagagacagaacctcgcctgtttgctcacaaacccac

SEQ ID NO: 5090 - DNA, 66 bp, Homo sapiens
gatatagtctcatttttaattgtcctgtcatggaacagtagccaattcactaaacttttgtgttca

SEQ ID NO: 5091 - DNA, 337 bp, Homo sapiens
gaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactaaacaaggttaccaagtgcggaattgggtaatactaaccg

SEQ ID NO: 5092 - DNA, 53 bp, Homo sapiens
aggggttacacagtcaccaaatgaatgtgcataaaccataaacagccctcttg

SEQ ID NO: 5093 - DNA, 347 bp, Homo sapiens
ccagcttaatctctcccactttagggtcccacaccgcccctaatccggcttgaagcggccctgagaaacatcgaccattctctcttcataccaccccccaaaaattttcgccaccccaagacttcaacactattttggattatttttcttattaatataagaaggcaggaatgtcaggcctctgagcccaagccaagccatcgcatcccctgtgacttgcacgtatacgcccagatggcctgaagtaactgaagatccacaaaagaagtaaaaatagccttaactgatgacattccaccattgtgatttgttcctgccccaccctaactaatcaatgtactttgtag

SEQ ID NO: 5094 - DNA, 496 bp, Homo sapiens
gggggctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcattgttgtaaagtgccatcagacaagatcagttgatcagaacagaaagctagctcggaaaatcctacaagagaaagtagatgttttctacaatggtgaaaacagtcctgttcacaaagaaaaacgagaagcggcc

SEQ ID NO: 5095 - DNA, 345 bp, Homo sapiens
gggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcattt

SEQ ID NO: 5096 - DNA, 402 bp, Homo sapiens; identical to SEQ ID NO: 4005

SEQ ID NO: 5097 - DNA, 336 bp, Homo sapiens
aaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaatttttttttctcactctaaaagaggggggggtcg

SEQ ID NO: 5098 - DNA, 335 bp, Homo sapiens; identical to SEQ ID NO: 4009

SEQ ID NO: 5099 - DNA, 351 bp, Homo sapiens
acaggcacctgccagctgcacctggctaatttttatatttttaatagagacggggtttcaccatcttggtcaggctggtcttgaactcctgaccccgtgatccacctgcctcggcctcccaaagtgctgggattacaggtgtgagccaccggggctggccagtttttatatttttagtagagacagggtttcaccatgttggccaggctggtctcgaattcctgacctcaagtgatccacccaccttggcatcccaaagtgctgggattacaggtgtgagccattttgcccggctgatattagtaaattttacaaacatagtttcttcagagatgaccaggggaatacaga

SEQ ID NO: 5100 - DNA, 173 bp, Homo sapiens
aacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgcgatctgagttcaga

SEQ ID NO: 5101 - DNA, 149 bp, Homo sapiens; identical to SEQ ID NO: 1785

SEQ ID NO: 5102 - DNA, 408 bp, Homo sapiens
ggatttggcgccctcctctgtggattctggccaggccgggttcggcggttgctgtgagagcgggcttcccaacaccatgccgtccgccttctctgtcagctctttccccgtcagcatcccagccgtactcacgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttat

SEQ ID NO: 5103 - DNA, 103 bp, Homo sapiens
gggtcaaaaagctccagcccagaaagcacctgctccaaaggcatctggcaagaaagcataagtggcaatcataaaaagtaataaaggttctttttgacctgtt

SEQ ID NO: 5104 - DNA, 367 bp, Homo sapiens; identical to SEQ ID NO: 4013

SEQ ID NO: 5105 - DNA, 430 bp, Homo sapiens
caacatacggttgggtgactcaaggacaacctggacgtcaccaatgcccagcttcacgggggcatgtagtgtgactcacggctgaacacaaaatcactgtgaagcctgtgctacagccctgggcgactttgggacacgcaagaggacactcggttacatgagacctgacttgctcgggctgtacccagaaggatgtccagtcgcggaggccaggagagaggtgggcaggcctgggtctggcagtggagacggtcctccagggagccgttgggcaggaagccgtacaccaggcagtagaagccgttctgagcacagtagccagaaaagtccacaatgtttgggtgaccaaacctggacagctgctccacctcggtccagaagctctgttcactgcagtccactccaagtcaacgttccccttcagcttttt

SEQ ID NO: 5106 - DNA, 803 bp, Homo sapiens
  misc_feature 611: n = A,T,C or G
gcaattggtttgagaaggtttaataatttggggtcagcagaaaagaatgttaggtccagctcatgggtgtgactttctccacgccccgcgggaagaaatttagaacaaaagatggtggtcagagttcaggtcccagatctcacttatctgaggtctacgtgcaagtggatgtgcaagcagatctgtttggtgagggttcggtttcttccaaatttaatacaaaagccacatttggattttccgatgtcccaagtgtgtctaggcactgcggaacgtcgtcatgtctttgggttctctgctggggacgcaccagtcatcagcctcgtggttggtgttgtaatgcttccaggcagctttgttatacactgggagtctttctattgagtctgttgacagagccttaatgtagataactgcatctgtcccgtaaccctctagggaatacagcttcaggtctccttggaagtattgtgcgtaaagacgtgatatgggcaatccataaccaaaaccagccagaggcactgcgcgggaggtctcaacacgaggtcttggtgcagttgaatacatgtagttgaaaagtctgtcaattttcctcaaaggaacgccacctnctcggtcactcatcttcacagtcaaatcctcattacccagcgtgacatgaactttgattaggaggtaaacacctctgttggcattgtagttcatagtggctctcattgcattcttgaaaaagttaacaccatgtgatagaagatggaatgtacataaaccactagtaattgctgtactggtgattttgcatt

SEQ ID NO: 5107 - DNA, 500 bp, Homo sapiens
gagaacagacacaggctggggcagcaggggctgggggcggccacaatcactgctcagcttctccaaagacgtcgttctgtttgcgcttcatgttctcaaagtcaaaggccgtgcagccatgcgtttgtagatgtctttgatgtcgttgcaggttgtctcaaagtgtgtggtggcatcgtaggagcaggaacagaacacctggctctcacaaccatcatcaatgggctcatacaagtcactgatagccacaaacttctggtcaatgggctccaacagctccagagccggctccacctccttttcagggtccgtggtctccacagtagtgctggcaatagctatgtacttgccctgggccgccacgttgtgtgcataggagatcatgcacacgtagatgtctgacttcctgttgacctggttctgggggatgattatttggcaggagttggcgtcgttggtgttcttgatggggtggctaaggatacagatgatgcggataa

SEQ ID NO: 5108 - DNA, 556 bp, Homo sapiens
gtttttgaatttggattcttttaatagcctcataataagtgccatacagggtttttattcacaggcttgaatgacaaagaaattctgacaagtttaatacccatctgtgatttaagtctggcaaaatacaggtcattgaaacagacattttaactgagttttataaaactatacaaatcttccaagtgatcataaatcagtttctcactacaggtactttaaagcaactctgaaaaagtcacacaattacacttttaagattacagtgtttaatgtttatcaggatacatttctacagctagcaggataacagatgagttaaggggcctcagactacatccaagggaatgtttattgggcgatcccaattacaccacaagccaaacgacttccagcgtttcctgtctttgtactttcttcatttccacctttgcccaagtcatctgctttttcatggaccacagtgtgcggccaatgatgcaatggtctcctgagagtgagatcacagaatcttcaatagacacacgggccacaccatctttgtcagcagtcacat

SEQ ID NO: 5109 - DNA, 491 bp, Homo sapiens
tttagacatttttcctctagagtagcttttcaaggccttctcatgaacagccttaagttttattgtcaaaataaatgcacttattttgggaaacagtttgaagtaagtaataagcatttgccactgtacttacaacttctcttgaagttcgctttctatttaggtcactagcttttaaataaagccaaccctggttctgcgttacttactacattttacctatagtcattcccacaaaggatgcaatattatattagaaagaaatattactttaaatttgttgaaaaatagaaggaccaatttagagctctgacctaggttcagtcctggaaatgggtctttcataaattcagatccaattacttccacagttttattactgttcagtttattactaacctgacaagcctaattgggtaacatttcactccctcattgggttttatacaaaatgctgtaggagaaagttaattaaacactatattaagtat

SEQ ID NO: 5110 - DNA, 696 bp, Homo sapiens
atagagaagacagaaagctggaattctttttaatgtttaacttttctttgtaaaaaacttattaaaaaacttaaatggtcagttaaagttaaaaatctattgctgcacaatttaactgattaaaagatttccagatctcttgactccaagagtcatttctttcatttcttacagatctcacacttccagatttctctttagcaaacatgatctgaaatcatttgtaggtaatcagcacttcaagcttcattccactttgattctcatcagctcccatcttcctcctccacagagtttcagaaccaaggaatgaaacttctcaaggctctgccgatgtcccacactgatgaacgtcatccccagctgctggccgatgcgatagagctcgctctccacttcctctgtcagggcactggtggcttcatcaagcactgcgtacttcggctgcaggtagaagagtcgggcaaaggagagccgttgcatctcccccggggacagaacatcataccagttccagtccacctgcttgtccaaggccctctgttctttgccacaaattgggacagccctgccaattccaaagaacctcaagatcctctcatcatcggcagaaacctgagtcggggtagaccttctttcagggatatatcacctgcttcccgagggtccccgtcagtgaaaaaatggtttttgtgg

SEQ ID NO: 5111 - DNA, 688 bp, Homo sapiens
gaatttggccctcgaggccaagaattcggcacgaggctctgctgtccttagagattttcaacttaaatcaaaaccaagccctactgcctgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcattgcgagttc

SEQ ID NO: 5112 - DNA, 501 bp, Homo sapiens
tttaattttagaagtgttttgggtctttattagaaatttggtagtgtttttgtaaccagaaatatatgccatagggacttaactcttatttatatcagttcacctatggtaaaattgatttcattatatgttgtttttcttaaacttgcagtttcccagaacctatcaacaacattgaggacttattgtattataaattatctttatatgaatataaagactttccctatttcaattgcgaatatacagatctgtgcactcaaaaataacaagcctattaggactcaaacagttatttgtatacccacgttcacagaagcattattcacaatagccaaaaagcagaagcaacccagtgtccattaatggatgaactgataaacaaaatacggtatttacatactacggcatatttggcctttaagaggaaagaaattctaatacatgctacaacatgaatgaactttgaagacattatggtaaatgaaataagaatgaatc

SEQ ID NO: 5113 - DNA, 890 bp, Homo sapiens
  misc_feature 507, 607, 663: n = A,T,C or G
gacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgncaccttgggctacctgcccacccagcaggacgtgctgcgggtccgcgtgcccaccaccggcatcatcgagtaccctttcgacctggagaacatcatcttncggatggtggatgtggggggcccagcgtccgagcggaggaagtggatccactgctntgagaacgtgacatccatcatgtttctcgtcgccctcagcgaatacgaccaagtcctggtgggagtcgaccacgagaaccggatggaggagagccaagccctgtcccggacatcatcacctacccctgggtccagaactcttcgtcatccttcttcttacaaggaagacctgctggagacaagatactgacttgcactggtggctacttcccccagttgatggcccc

SEQ ID NO: 5114 - DNA, 711 bp, Homo sapiens
  misc_feature 657, 670, 678, 695: n = A,T,C or G
agatatttttcctataggtttctgctgtggagccgtactcactgcagaccctgaaggaggaggagcacctgctttctgccactcagtggcctcagctgccattcttctcacatatgcatcatccacacacatcaagatattttccggctttatgtcagtatgaatgatcttgcacttactgtgtaagtaatctaacccttgaaggacctgtcgaatgatactcttcacacaacgtactgggaggccttgatagttggatttgatgatccacttgaggagatggtggccaagtacttcgaagaccatgcagacatgtatcccattcatgcctgaaatcttgaagtcgtcaatgagctggaccaccatgtctttgtttgggtcactgggatcactttctcgaacacatttgagcaattttatttcatccaaggctgtctccgtataatgctgggcactttttacaactttcattgcaacaaatcttttcccctgcatatcccagcacagccagacagtagagaagtgcccccatccaagctttctaataacatgataccggccattgaagaggtctccaattttcactggatgatatccacctttgcagtagtccgcagggtcctcttgctcctcatcatctgatccccagatctcctnctctggctcccgnggtgtggngtcttggcaaagtggcngttgtggtggtggtgc

SEQ ID NO: 5115 - DNA, 497 bp, Homo sapiens; identical to SEQ ID NO: 4015

SEQ ID NO: 5116 - DNA, 294 bp, Homo sapiens
gcgacgctcatagtgcgctctcctcttcccccggggggatcctcgctcgccttctggctctgacatgccctgctctgaagagacacccgacatttcacccagtaagcgggcccggcctgcggaggtgggcggcatgcaactccactttgcccggctctcctagcacgccacggaccccacccggggctccgcgcgcgccgcgggctacgacctgtacagtgcctatgattacacaataccacctatggagaaagctgatgtgaaaacggacattcagatagcgctcccttctgg

SEQ ID NO: 5117 - DNA, 232 bp, Homo sapiens; identical to SEQ ID NO: 4016

SEQ ID NO: 5118 - DNA, 294 bp, Homo sapiens; identical to SEQ ID NO: 1029

SEQ ID NO: 5119 - DNA, 392 bp, Homo sapiens
atcaatgctgacttcctcgtcttagaaattgtactattggccaggcgcagtggctcacacctgtaatcctagcactttgggaggccgaggtgggcagatcacctgaggttgggagttcaagaccagcctgaccaacatggagaaaccctgtctctactaaaaatacaaaattagctgggcatggtggcgcatgcctgtaatcccagctactcaagaggctgaggcaggagaatcgcttgaacccgggaggcagaggttgcagtgagctgagatcgtgccactgcgttccagcctgggcataaagagtgaaacttcatgttataaaaaaaaagaaaagaaggaaagaattggtcctgttgtggccaggcccgggggctaatgcttataatcct

SEQ ID NO: 5120 - DNA, 298 bp, Homo sapiens
gctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgc

SEQ ID NO: 5121 - DNA, 486 bp, Homo sapiens
attattcctaaaaaggccattagtaaagcagcgggccaatggtagttcttactaggagctctgtttctcctctcatcctcccctcgtctccctcataaattaacattagaattattgctttgtagtttgattatatctttatatcctgatgactgtctaattccactgaaacaaaattgcaaattattcctcccttgacattttgtctccaaaataagtaaatacacaattattataaaagttataaagtaatcaatacaaaataaggaagaaacaaataatctctttattttccctaggccactgagaaaatcccaggcccagcagatggttctggcctgactctgtttcttacatttcatctggtcttaaatagttattgaatagtcttaagatcagtttttctatctataaactggtgaaacaaaatgtgtttttcaccttcagggtatttttttgagtgttaaaaacttatggaaacattct

SEQ ID NO: 5122 - DNA, 328 bp, Homo sapiens
cggaggcggtagtgacggtggtgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagt

SEQ ID NO: 5123 - DNA, 491 bp, Homo sapiens
ggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctgg

SEQ ID NO: 5124 - DNA, 267 bp, Homo sapiens
agaaattactcggaaggcttccactagggtccaccaggagttctgcgaccccctgaccagtttccagggggggggcaccacgacgccctcgaggttgctctggagatcccatcgataagctcgcttgttcttttggccgaagcggccaataaaccgctcaactttggcagatagaattctgcagatatccatcacactggcgggcgctatgtacgttgatccagacatgataagatgcattgatgagtttggacaaaccacaactag

SEQ ID NO: 5125 - DNA, 523 bp, Homo sapiens; identical to SEQ ID NO: 4019

SEQ ID NO: 5126 - DNA, 511 bp, Homo sapiens
gcgcgcagcctgcgcatgcgcgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttg

SEQ ID NO: 5127 - DNA, 398 bp, Homo sapiens; identical to SEQ ID NO: 4022

SEQ ID NO: 5128 - DNA, 65 bp, Homo sapiens
agatctccctgacttgcaggaacagggtccagatcatggctctctatgctgacctcagtggaaaa

SEQ ID NO: 5129 - DNA, 346 bp, Homo sapiens
gcctgcccaccatggaaggacccccaaccttcaacccgactgtgccatatttcgggaggctgcaaggatggctcacagctcgaagaaccatcatcatcaagggctatgtgcctcccacaggcaagagctttgctatcaactacaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagca

SEQ ID NO: 5130 - DNA, 270 bp, Homo sapiens
gggttggcattaaattgatataaagacaccctggcctggaagttaaaagttttttttctttcttttttgagacagagtcttcctctatcgcccaggctgaaatgcagtggcatgatcttggctcactgcaacctccacctcctgggttcaagcagttcttgtgcctcagcctcccgagtagctgggactacaggcatgcgccaccatgcccgactgatttttatatttttagtagagacggagtttcaccatgttggccaggctggtctt

SEQ ID NO: 5131 - DNA, 500 bp, Homo sapiens
cttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctc

SEQ ID NO: 5132 - DNA, 170 bp, Homo sapiens
gggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaaaaaaaaagg

SEQ ID NO: 5133 - DNA, 159 bp, Homo sapiens; identical to SEQ ID NO: 1848

SEQ ID NO: 5134 - DNA, 611 bp, Homo sapiens
ctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcgtgcaagaggccctctcggggacgccctgcctcctaggacctggacctgttctcaccgtcctggcactgctcct

SEQ ID NO: 5135 - DNA, 109 bp, Homo sapiens; identical to SEQ ID NO: 4027

SEQ ID NO: 5136 - DNA, 441 bp, Homo sapiens; identical to SEQ ID NO: 4031

SEQ ID NO: 5137 - DNA, 508 bp, Homo sapiens; identical to SEQ ID NO: 4033

SEQ ID NO: 5138 - DNA, 518 bp, Homo sapiens; identical to SEQ ID NO: 4034

SEQ ID NO: 5139 - DNA, 337 bp, Homo sapiens
ggggctgaggagccgccgcgtcccctcgccgagtcccctcgccagattccctccgtcgccgccaagatgatgtgcggggcgccctccgccacgcagccggccaccggcgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacgagcccttgaccttatctaactaccagaccaacggaggcg

SEQ ID NO: 5140 - DNA, 479 bp, Homo sapiens
aaaaatccaagttcatttgggatcttgtttacttatcatctagataaaaagtttgcaaactatagccaaagggcccaatcccacctgccacctgattttataaataaagttttactggagcataactgcacctatttgttttgttttgttttttgagtcggagtctcgctgtgttgcccaggctggagtgcagtggcacgatctcagctcactgcaagctccgcctcttgggttcacaccattctcctgcctcagcctcccgagtaggtgggactacaggcgcccgccaccacgcccggctaattttttgtatttttagtagaaatggggtttcaccgtgttagccaggatggtcttgatctcctgacctcgtgatccacccgcctcggcctcccaaagtgctgggattacaggtgtgagccaccatgcctggcccacctatgtgtttacatatgatctatggccactctttcactaca

SEQ ID NO: 5141 - DNA, 505 bp, Homo sapiens; identical to SEQ ID NO: 4035

SEQ ID NO: 5142 - DNA, 377 bp, Homo sapiens; identical to SEQ ID NO: 4037

SEQ ID NO: 5143 - DNA, 479 bp, Homo sapiens
aggtgagtggatcacttgaggtcaggagttcgagaccagcctgaccaacatggtgaaaccccgtctctactaatattacaaaaatcagccaggcatggtgttgtgcgcctgtaatcccagctattcgggaggctgaggcaggagaattacttgcacctgggaggcggaggctgcagtaagccaagatcgcgccactgcaccccagcctgggtgacaagagcaaaactctgtctcaaaacaaagaaaaaagagaaggaaagaattagaaaatcaccatgttgcaaaagccagcaaaatcattgatgcatacagcgatcatctataggtgctaaaaaaagtagatgaggccgggtgcggtggctcatgcctgtaatcccagcactttgggaggccgaggcgggcagatcacctaagatcaggagttcgagaccagcctggctaacatggtgaaaccccatctctactaaaaatacaaaaat

SEQ ID NO: 5144 - DNA, 507 bp, Homo sapiens; identical to SEQ ID NO: 4041

SEQ ID NO: 5145 - DNA, 353 bp, Homo sapiens
tgccttcatttacgagaagcggggtggtacatactgggccctgctgaggactctgctagcgctggcagatttctccacagccatcgctgccctcaaactttggaatgaagatttccgatatggctactcttattacaacagtgcctgccgcatctacagctcgagtgactggaacactccagcccccactcagagtccagaagaagtcagaaggctacacctatgtacctccttcatggacatgctgaaggccttgttcaaaacccttcaggccatgctcttgggtgtctggattctgctgcttctggcatatctggcccctctgtggctgtactgctggagaatgttcccaa

SEQ ID NO: 5146 - DNA, 387 bp, Homo sapiens
ttagaaggagatctgtattctatccaaagctaatcttataaagagactgtctaaaaagtgtggcttcttatttatgctctctgacttatccaactaagaaataaaaagtggctgggcgtggtggctcacgcctgtaatccctgcactttgggaggccgaggcaggcagatcacgaggtcaggagatcgagaccatcctggctaacacggtgaaaccccgtctctactgaaaacacacaaaaaactagccgggcgtggtggcgggcgcctgtagtcccagctattggggaggctgaggcaggagaatggcgtgaacccgggaggcggagcttgcagtgagccgagattgcgccactgcactccagcctgggcgacagagtgagactcc

SEQ ID NO: 5147 - DNA, 271 bp, Homo sapiens
aaattagctgggcgtggtggcgggcatctgtagtcccagctactcaggaggctgaggcaggagaatggcgtgaactcgggaggcggagcttgcagtgagccgagattgtgccactgcactccagcctgggtgacagagcaagactctgtctcaaaaaaaaaaaaaaaaaaaaaaaaaaggggggcgtttttttctgaaaccccgacggggaaaaaacctttgggggggtgggacccccccacttaaaggggggggaaaaaaaggttttttg

SEQ ID NO: 5148 - DNA, 489 bp, Homo sapiens; identical to SEQ ID NO: 4045

SEQ ID NO: 5149 - DNA, 228 bp, Homo sapiens
gccgcatcctatggctctactttgagaccggtacctgggtgtatcctgtgtttgccaaactcagcctgttgggtctagcagctttcttctctctcagctacgtgggggtcgccagcatctacctacttggagagaagctcaaccactggaaatggggtgacatgaggcagccccggaagaagaggaagtaattgcacaccattttccaagaacctagaaagaagaaaa

SEQ ID NO: 5150 - DNA, 449 bp, Homo sapiens; identical to SEQ ID NO: 4048

SEQ ID NO: 5151 - DNA, 458 bp, Homo sapiens; identical to SEQ ID NO: 4049

SEQ ID NO: 5152 - DNA, 457 bp, Homo sapiens; identical to SEQ ID NO: 4054

SEQ ID NO: 5153 - DNA, 399 bp, Homo sapiens; identical to SEQ ID NO: 4055

SEQ ID NO: 5154 - DNA, 418 bp, Homo sapiens
caagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgacgaatatgatgaggaggaggaagattaggaggaggaatatcctgtcaaagaagcacctggaaaa

SEQ ID NO: 5155 - DNA, 648 bp, Homo sapiens; identical to SEQ ID NO: 4058

SEQ ID NO: 5156 - DNA, 610 bp, Homo sapiens
  misc_feature 524, 579, 594: n = A,T,C or G
attcatttttattatattaatagacttagttacatataaataaacacaaaaagcaaatatcaactgaaaggtttggttgggtagtcaactaattttgttcttttctagggcaattcaagaaggtaacatttgaaaggtttctaaatgatgcacactgtaatcattcattctttgttaaaatacaacacaaaccaacagctacaatgctttttatttttaacaaaaaggatgtaaggagggtaagaaaaacagaggacagtaagataggatgtaaagtgtgatgtatctctggacaccatccctctctgcctgccccacacccaaaagttttaaataatttaaaggataccaattacagtaccagaacaccatcaaaataattgtctttatcagggtcaaaaaatacagtgattatgaatgagctgtgaccagttacgaaattttactggaaatgtttaactgtggtcagcagtccaatggtgtgcacagtgccttcaattaatgcacttgagcatccgtaattncatttctggcagggtccacaccccccaagaaaaggtaagctaagcattcattccncatctaacctggaanacgagccagttaaaga

SEQ ID NO: 5157 - DNA, 512 bp, Homo sapiens
gaagggatgggcaagggtgagtgggtttgctccacaccgtcctgtgctgctcgatgaggacctgggacgtgcgagggaaacgtgggtgacggtgcctaggctgcggccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgt

SEQ ID NO: 5158 - DNA, 618 bp, Homo sapiens; identical to SEQ ID NO: 4059

SEQ ID NO: 5159 - DNA, 601 bp, Homo sapiens
tcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgct

SEQ ID NO: 5160 - DNA, 571 bp, Homo sapiens
ccaagaattcggcacgaggagatattccaacctagagttttggatggaactgatatattgacagttctcaccgaagtccttttataaagaattgctactccaatatatggtcagattagatgcaagaataaatcagttgtccgagtctaagtttctattttattaataaaaactaaaatggtacgtactatcggtcatttcattttcattcttttaatcatgtattcaagcacaaacttgaaatttcatagccataatgtcaagatttagacctaccaaataaaaccttgggccagctgtgttaaggatttgctcaccttttcccaaactataccttgataattatttccttgataccctacttacaaaatgaagtagatgacattaaaaaggcaaacagagactggccacgctggcttactcctgtggtcccggcaccttgtgaggccgaggcgggtggatcacctaaggtcaggagttcgagaccagcctcaccaatatgatgaaaccctgtctctactaaaaatacaaaaattagccgggcgtggtgacatgcgcctgtgatatcagc

SEQ ID NO: 5161 - DNA, 148 bp, Homo sapiens; identical to SEQ ID NO: 4060

SEQ ID NO: 5162 - DNA, 561 bp, Homo sapiens
tcggcacaggctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagactatggaataaaactattgatgcgatgaagagagttgaagaaatcaaacagaagcgccaactaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaag

SEQ ID NO: 5163 - DNA, 693 bp, Homo sapiens
tcactatttggaatttggccctcgaggccaagaattcggcacgagattcgattttacatgtatgagattctgaaggccctggattattgtcacagcatgggaattatgcacagagatgtcaagccccataatgtcatgattgatcatgagcacagaaagctatgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagc

SEQ ID NO: 5164 - DNA, 559 bp, Homo sapiens
gaggagttgaggacatttatttcacattcacacaactgtacattttctataaataatgtggggctgaaatatttacagtcatttcttgcccatacccaggcagtctctccctcctgacaccccgtgcctggagagacagcctgcagacagatgtgcaaacccagcttggtctttcctgccccctccctgatgctcaggcagagcagccagcggtccctgggactccactagcctcgaccactccatcctctgatgccgaagtgtgacaggccacagggaattcgccgctccactgcagtcacagaggctgtggcaggcagcagccaacactgcgggccctgggcagtagctgccggctagggaatgcagaaggaagcagggaggctgccactcactccggctgccccccaattcttcccttcctctctgtgcccttcctctgagagggtgagccccagggttccctcactcctcacagagtgaaactgctccaggcgcccagtcatgccgggtcacagagaagggagagccagactcttgcagtggacagttataacgc

SEQ ID NO: 5165 - DNA, 491 bp, Homo sapiens
cctcctttgttactagtttggagcagatccttgcagacgttttcctctgcattcacatgcatgcaaatgtacttctgaatgcgcacgtatgtctttatatacagatagcttttaacaaatagcaggtggggccggcactgtggctcacacctgtaattccaggactttgggaggctgaggcggggggatcacttgaggccagaagttggagaccagcctggccaacatggtgaaacaccatctctactaaaaatacaaaaattagctgggcgtggtggcgggtgtctgtagtcccagctactcaggaggctgaggcaggagaatcgcttgaacccacgaggcggaggttgcagtgagctgagattatgccactgcacgccaacctgggtgatagagcaagactctgtctcaattaaaaaaaatatgtggggccaggcaccgtggctcacacctgtaatcctagcacttttggagactgaggcgggtggatc

SEQ ID NO: 5166 - DNA, 329 bp, Homo sapiens; identical to SEQ ID NO: 1037

SEQ ID NO: 5167 - DNA, 337 bp, Homo sapiens; identical to SEQ ID NO: 2816

SEQ ID NO: 5168 - DNA, 344 bp, Homo sapiens
acctcaacgtcggtaccgccgcaacttcaattaccgacgcagacgcccataaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagatatatgaaattccagcaataagaaatgaacaaaagattggagctgaagacctaaagtgcttgctttttgcccgttgaccagataaatagaactatctgcattatctatgcaacatggggtttttattatttttacctaaagacg

SEQ ID NO: 5169 - DNA, 348 bp, Homo sapiens
  misc_feature 292: n = A,T,C or G
cgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgngtatcattcattacattcttgagttgttttgggttttttttttttttttaaaacca

SEQ ID NO: 5170 - DNA, 124 bp, Homo sapiens
gagaagacgacagaaggggtgattattatatttaccacataatctgtgtcctttcaaggctgtcaggaatacaaaggcaggcatggtcaggaaagaataaaggagagatgagtcttatttcttt

SEQ ID NO: 5171 - DNA, 370 bp, Homo sapiens; identical to SEQ ID NO: 4068

SEQ ID NO: 5172 - DNA, 424 bp, Homo sapiens
gctccacctcccgggttcacgccattctcctgcctcagcctcccgagtagctgggactacaggcgcccgccaccacgcccggctaatttttttgtatttttagtagagactgggtttcaccgtgttcgccaagatagtctttatctcctgacctcgtgatccgcccgcctcggcctcccaaagtgctgggattacaggcgtgagccaccgcgcccagccaggagaattatttttatagtctcagagttgtatagtcttttctaatatgccacaaaaactaagaaagaatagataattgattaatcagactacataacaaaacttttctgcatataaaaatacattataaacatatgacgaactaattttcaaaagtaaaatggcatgcccaaaattaagagccaatattcttaattcataaaga

SEQ ID NO: 5173 - DNA, 392 bp, Homo sapiens
actgaccacccctcctcttctggaatgtgtgacctggattgtgctcaaggaacccatcagcgtcagcagcgagcaggtgttgaaattccgtacacttaacttcaatggggagggtgaacccgaataactgatggtggacaactggcgcccagctcaaccactgaagaacaggcaaatcacagcttccttcaaataacatggtcccatagtctgtatccaaataatgaatcttcaggtgtttccctttagctaagcacagatctaccttggtgattcggaccctggttgctttgtgtctacttttctagacccttcatctcttacttgatagacttactaataaaatgtgaagactataccaattgtcatgcttgacacaactgctgtggctg

SEQ ID NO: 5174 - DNA, 473 bp, Homo sapiens
taattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataat

SEQ ID NO: 5175 - DNA, 462 bp, Homo sapiens
ccatatcaatctagaaacagctactttattcatcttccattataacatatgccagacataccaaaaaggaaggcacacctgatgcttgaaatgatcctattatatggatgcttcaaaatttgtttaacctgtcccctattgctcaacattcagaattttctcaattttccttacaaataaaaacactgcacaacaacaaccactagagctaataaatgaattcagcaaagtagcagggtacaaggttaaccaaaaaaaatccattgtgtttctatacatcaacaatgaataatccgaaaaggaaatttaaaaaacggttctggccaggcgcggtggctcacgcctataatcccagcactttgggaggctgaggtgggcagatcacgaggtcaggagatcgagaccatcctggctaacaaggtgaacaccgtctctactaaaggtacaaaaattagcaggcgt

SEQ ID NO: 5176 - DNA, 143 bp, Homo sapiens
taaccagttgttggagagatctggcccctccccacaaattctctgtgtccctctaggatacctcaaataacaataatgatagcaacgataaaaagaagacccaaaaaaaaaaaaaaaaaaaaaaaaaaaagtcgtatcgatgt

SEQ ID NO: 5177 - DNA, 77 bp, Homo sapiens
tgatgaggactgacaattaacagcaaaaaaaaaaaaaaaaaaaaaaaaaaaacccttttttttttttttcccccccc

SEQ ID NO: 5178 - DNA, 173 bp, Homo sapiens
gccgcctgccatgccccagccagtccccacagcataacagggtctccttggcagctgtattctggagtctggatgttgctctctaaagacctttaataaaattttgtacaaaaaaaaaaaaaaaaaaaaaaaaagttttttttttttcccccatatttttttttttttccccc

SEQ ID NO: 5179 - DNA, 359 bp, Homo sapiens
acgacagaaggggttcaagcgattctcctgcctcagcttcccaagtagctgggactgcatgcgcgtgccactgtgcccagctaatttttgtatttttaatagaaacggggtttcatcacgttggcaggatggtctcgattcctgacctcgtgatctgcccacctctgcctcccaaagtgctgggattacaggcgtgagccactgtacccggcctcctttcttaaaggtaaaaccgttctctaatccacctagtctccatagcattagtgccacaagaacattttactcttaaatgacttgtctaattctttgcagataccaaatataaagccagaacatttctagggatatgtatgacg

SEQ ID NO: 5180 - DNA, 610 bp, Homo sapiens
ggtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacataaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaat

SEQ ID NO: 5181 - DNA, 384 bp, Homo sapiens
atagctcatgcctataatcccagcgctttgggaggccaaggggggaggatcgcttggggccgggagttggagaccggcccggggaacacagtgagactttatctccttaaaaaaattagctgggcatggtggtatgagcctgtggtctcagcttcccgagtggctgggactgcaggtgcatgccaccatgcccaactaatttttgtatttttagtagagatgggatttcaccatatcggacaggatgggctcgaactcctgacctcaggtgatccacctgcctcggcctcccaaagtgctgggattacaggcgtgagccactgcgcccggccacaaataataatttgatgaacagaatttcttctttttatttttaaaaagatc

SEQ ID NO: 5182 - DNA, 313 bp, Homo sapiens; identical to SEQ ID NO: 4073

SEQ ID NO: 5183 - DNA, 127 bp, Homo sapiens
aagactgtggcgaggaataggacgaggaagaataaggtgatggtgacgaagaggatggatatgatgatgacgaagctgagtcatctacgggcaagcgggcagctgaagatgatgaggatgacgatgt

SEQ ID NO: 5184 - DNA, 302 bp, Homo sapiens
tcaaagggaaggaattgtagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaatt

SEQ ID NO: 5185 - DNA, 372 bp, Homo sapiens
gccctttcccctggctggcagcgcggaggccgcacgatgcctggagttactgtaaaagacgtgaaccagcaggagttcctcagagctctggcagccttcctcaaaaagtccgggaagctgaaagtccccgaatgggtggataccgtcaagctggccaagcacaaagagcttgctccctacgatgagaactggttctacacacgagctgcttccacagcgcggaacctgtacctccggggtggcgctggggttggctccatgaccaagatctatgggggacgtcagagaaacggggtgatgcccaaccacttcagccgaggctccaagagtgtggcccggcgggtcctccaagccctggaggggctgaaaatg

SEQ ID NO: 5186 - DNA, 212 bp, Homo sapiens
tctgtgtgagcccattctactcattagggtacagatttttaatagaaactatgtctatgcatggcttattctatattgatggaagagaagtctaatttgagcagagagccatacaaacatggagtcctgcactgtactcaagatatttctccgtatttacgtattgaaaaaatgactgatgggctcttattacctaatggacactatataaa

SEQ ID NO: 5187 - DNA, 333 bp, Homo sapiens
gcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaact

SEQ ID NO: 5188 - DNA, 331 bp, Homo sapiens; identical to SEQ ID NO: 1047

SEQ ID NO: 5189 - DNA, 339 bp, Homo sapiens; identical to SEQ ID NO: 1048

SEQ ID NO: 5190 - DNA, 319 bp, Homo sapiens; identical to SEQ ID NO: 4092

SEQ ID NO: 5191 - DNA, 348 bp, Homo sapiens; identical to SEQ ID NO: 1050
  misc_feature 348: n = A,T,C or G

SEQ ID NO: 5192 - DNA, 96 bp, Homo sapiens
acaaaacgaactgcacagaaccgcaccacaggcgtctgcttgcgtcaataagcattaaaacataccatgctgcgttaataaattgcctcattccaa

SEQ ID NO: 5193 - DNA, 361 bp, Homo sapiens
gaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaag

SEQ ID NO: 5194 - DNA, 125 bp, Homo sapiens
ttaagttgttgcaacagagactatatggctagtgaagtccaacatatttactactggccatttacagaaaaagtctggactgcaaggaagaccaaaaaaaaaaaaaaaaaaaaaagtcgtatcga

SEQ ID NO: 5195 - DNA, 127 bp, Homo sapiens
ctatcaggaggagggaccagcacaagcaccttacagagtgcatgcactagtcagggtcctggaacagtccagagaagcggtgggagccagtcaggaaagacattttgggatctgattgttaaatgcc

SEQ ID NO: 5196 - DNA, 859 bp, Homo sapiens
  misc_feature 3, 127, 212, 330, 331, 337, 345, 346, 369, 435, 546, 611,656, 689, 722, 730, 738, 772, 777, 782, 834: n = A,T,C or G
ggnacgaggggaattgtgccctcataaaagggaccccagagaactgctgcaccccctccaccacgtgggacacagtgagaaggcactggctacgaaccaggaaaccctccccagacaccagatctantaacaccttcatcttgggacttccagcccccagagcagtgagaaatacattcctgttatttgtaagcctcacggtttacagtgtnttgctatcacagctcgaatggactaagacagcaggaaacagaatacagagaacatggagagaagcaaggcttttctgggtgtgaacttcccaagcatgcaaaaattttacacaatcannaaacanaaaattannttgtaacatttaaaatgaactanaattaatgtaactgcctatcaagccagtgacacaatcacacaagcaacatttctggtgccgcgaanacaagactgggcccagcttccatgggacatgttctaaggagtgagacgctgcaaagaagcgcagatgccatccgggagctggactggtgcttactgttatcggtaatatcnggagtgctattttgaaactaaagattttagaaaccagaatttttattgtaagagatgcaatatanatcccagaagttggtaagaactctaccctgttaatttgaattggnatattagcatgagcacatttttaagatccattncttcataactctgttccctgaaagtggtcagtnccatggancctgcagngtgggaccccgattcattcgtgtcaaaatcttcnttccnaggcnagggatctggggaatggccgttaaagtttggcaagacctagggagcccgggntcctgtcccgaggaaatttcccaag

SEQ ID NO: 5197 - DNA, 297 bp, Homo sapiens
attgggtaccgggccccccctcgagtttttttttttttttttaaaaaaagaaacccttttttcccttgtttggaaaaaaaaacgggcaaagggggtggcttttgggggataagcaaaaaaaaccaaaccccatttcctggcccaacccctccaacttttcttgggtttaaaccttagggggggctgaaaaaacaaaaaaaccagctgggggggaaacacccacgggggcaccacccccaagggcaaagggttcacccaaaagggccttgcccttttaaaaaaggggaaaggggaaac

SEQ ID NO: 5198 - DNA, 610 bp, Homo sapiens; identical to SEQ ID NO: 4095

SEQ ID NO: 5199 - DNA, 512 bp, Homo sapiens; identical to SEQ ID NO: 4096

SEQ ID NO: 5200 - DNA, 780 bp, Homo sapiens
  misc_feature 516, 569, 663: n = A,T,C or G
gaaatgcagaaatatttattttggtttccttcattgtttttggaaattttgttttggtttataaaacatagaaatagccaacacttaaagcaaacattcaaaaccccaaggtgacaaattattgactttttgtgcaattaagaatacatatatgaagttaggctaccaagtagtgttattacaatgacaattctttagtgcaagccctgttgtgcttgtatataatacatgtactctcacagaccccaaaacagctgctttaaatgtacaaatgacagctcaattcagtcaaatgtggcaaagactcacaataaagtgaactgctgttaatttcccaaattaactttaaaaaatccctggagaagtgaatcccaggaaatgaactttccagatttctacatcctagaattttggcttgtcaaacacatttcatagaaatcaggtagcattataagaacatttgcttattactgtccatttcaataagtactcaagtatatactcccttaatagctntaaagaaatgcttgcctgagagtttattttttggggaaaaagggcagttaatnccaacatgatcttttgatatgaaaaccacattaaaaatctgtttggctttacacagagtgagtggttcagtgaagataagtagacagttatcangcgtcacagctgagcatggctgatccaggtactctttcttgaaatgcttggctcactatagaatctacgcagattttaaaataaccctgaaaaaggatgagtcggggatcaggcctg

SEQ ID NO: 5201 - DNA, 583 bp, Homo sapiens
tcttgctttaggattgctattttattgttgccctttctgttacatgggatgtacacatcaggtgttaaaaggtacaatacattctacaactgagcaccactttctgtaactgaacaggcaaagaaattacactgaacatcagcatctggcagtatttttttggaaaaaaaagtgactaaaatgggtttaaattgattaacactattaaatcacatctaatatttgatactacatgattcaatacagctatacgatacaattatacaaaatgtgttaacatcaaagaatacaaccaaaattaagatagcaaacaaaacctatataacttttttttttttacaggaaaatacttttgaagtatgcatgtaactgcccattcttttaaagaaaatctactgcaagcaaagttatcaacctccagaaaaatcacacgtagcattactaagcatatccccaaaaaagtgtacaatatgcacacttggaaaatacaaaattaaaaaaattgtaagcaacaggtgagcttcatatttataagaatgtgaaaagaagttcccatttttagcactgttgtgataaagaattg

SEQ ID NO: 5202 - DNA, 525 bp, Homo sapiens
gagacagggtctctctctattactcagctgggagtgcagtggcatgatgtctgctcactgcagcttcgacctcccaggctcaggtaatcctcctacctcagccccctgagtagctgggactacaggtgcatgccaccatgcccgactaattttttgtatgttggtagagatgcggttttgtcatgttgcccaggctggccatgaactcctgagatcgggcgatctgcccacctcagcctcccaaagtgctgggattataggcatgagccaccaggcccagcctccaccttctattttcatagacattattcatgaaaatttaaagcttaaataatagaactgcttatagaattaccttgggtaccaacaatctccatgtgaagatgggcaagaccgctcgccgtggacagagcaagttttatcattccttccacagtaactgtgtatctgtttaagtaatcaaaaagggatccatgctcatgataatctgacaccaaccagagctgagtccaagtaccattgtct

SEQ ID NO: 5203 - DNA, 135 bp, Homo sapiens
agggcgaattgggtaccgggccccccctcgagtattttttttttttttttgcataaatgagtccacttggattacctatagcaaataaacccatcccaagggtatggaatcaactgtttatagtcttttcacact

SEQ ID NO: 5204 - DNA, 585 bp, Homo sapiens
  misc_feature 540: n = A,T,C or G
cggcacgaggccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctntctggtacaggaactgtcaccgtgtcaacctgatggggagatatg

SEQ ID NO: 5205 - DNA, 456 bp, Homo sapiens
acgacagaagggagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctg

SEQ ID NO: 5206 - DNA, 411 bp, Homo sapiens
ctgaatcacatattccaggactgttagctgctatttatttttcatctacagatggcttcataaaagccattctccttattctgaaaaaagtccaagtggtagttagatattaatttaagatgcaaatcaggttatgcaggtggcataaaataactgcagactttaagaaccacaaatgaggggtggagctgacacagcaccatgcactggttgatggaagcacaactttttccacccgctttccacaagatcaacacctccactgtgaggccgcttttctcttacctgtagacaacgtaaagaaaattctaaaaacaatgctgtctccttaaattcctcttcatttcatgctgcttccacgttctagaccaggggtcagcaaattattctggaaagggtcaaacagtaagt

SEQ ID NO: 5207 - DNA, 366 bp, Homo sapiens
catggccatccccttatgagcgggcgaagtgattataggctttcgctctaagattaaaaatgccctagcccacttcttaccacaaggcacacctacaccccttatgcccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaa

SEQ ID NO: 5208 - DNA, 332 bp, Homo sapiens
gagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtggggcatgcagcattttggaaggaaaattgaagacgtgttcaagaaaacatgaacaggagccaatgatgg

SEQ ID NO: 5209 - DNA, 330 bp, Homo sapiens
ggggtcagtgccgcgcgccgatcggtcgttaccgcgaggcgctggtggccttcaggctggacggcgcgggtcaaccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaagaaggaagatctcatcag

SEQ ID NO: 5210 - DNA, 435 bp, Homo sapiens
gagcggcctgtgacagcgggcgaggaggacgagcaggttcccgacagcatcgacgcacgcgagatcttcgatctgaggcgctccatcaatgacccggagcatccactgacgctagaggagttgaacgtagttgagcaggtgcggcttcaggttagcgaccccgagagtacagtggctgtggctttcacaccaaccattccgtactgcagcatggccacccttattggtctgtccatcaaggtcaagcttctgcgctcccttcctcatcgtttcaagatggacgtgcacattactccggggacccatgcctcatagcatgcactgaacatgcaacttgcagataaggagcgggtggcagctgccctggagaacacccacctcttggaggttgtgaatcattgcctgtcagcccgctcctgagcctggcctttgacc

SEQ ID NO: 5211 - DNA, 350 bp, Homo sapiens
gcggttgggggaaagtaattccggctgttgcaccatggcgtccatggggaccctcgccttcgatgaatatgggcgccctttcctcatcatcaaggatcaggagcgggggtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatgggggaactgtccaagtctcaggatgatgaaattggagatggaa

SEQ ID NO: 5212 - DNA, 337 bp, Homo sapiens
  misc_feature 337: n = A,T,C or G
catacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttctttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcn

SEQ ID NO: 5213 - DNA, 241 bp, Homo sapiens
ctcattatagaactgactcaatttatggcccatggaagaaaatgaaagggactgtttagggactttacatactcttaggacttttattaaaatcccatgtcccggctgggcatggtggctcacgcctgtaatcccagcactttgggaggccgaggcaggtggatcacctgaggtcaggagttggagaccagcttggccaacatggggaaatgctgtctctaataaaaatacaaaaattacc

SEQ ID NO: 5214 - DNA, 339 bp, Homo sapiens
gggcggatcatgaggtcaggagatcgagaccatcctggctaacacagtgaaaccccgcctctactaaaaatacaaaaaattaaccgggcgtggtggcaggcgcctgtagtcccagctactcaggaggctgaggcaggagaatggcgtgaacccgggaggcggagcttgcagtgagccgagatcgcgccactgcattccagcctgggcgacggagcgaaactccgtctcaaaaaaaaaaagacatttacttaaggcaattatttataacccagggttgggcttatagtattacttaagggaggggccgggaccaaagcgttctgcagggaagtatccaac

SEQ ID NO: 5215 - DNA, 358 bp, Homo sapiens
gggaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctagagccaa

SEQ ID NO: 5216 - DNA, 450 bp, Homo sapiens
aggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaagctggtaacttttggaatgcattcactgaaaaaaattagaatatcaaactataaaccgtttacttagtcaactttttggggaactaatatggccataaatatcaaacctcctacaattttgcacattctttgactttgtagttctacatctataaacttctcttaagggaaatcatggatgccaacaaagaaatagttacaaaaatgttcagcagaggagcactatttataat

SEQ ID NO: 5217 - DNA, 481 bp, Homo sapiens; identical to SEQ ID NO: 2935

SEQ ID NO: 5218 - DNA, 436 bp, Homo sapiens; identical to SEQ ID NO: 4110

SEQ ID NO: 5219 - DNA, 93 bp, Homo sapiens
accgaacgcatgagccaagctccctactgtgtgacaaatgtgcgtattggaaccaagcttggatcacatatcaagctggaagattctttatgg

SEQ ID NO: 5220 - DNA, 254 bp, Homo sapiens
ggaaagctgaaaaaatgcacagtaaaaaattgtttgggcccaatgtggtggctcatgcctgtaatcttagcactttgcgaggccaatgcaggcagatcacaaggtcaggagatcaagaccatcctggccaacatggtgaaactctgtctctactaaatacacaaaaattagctgggcatggtggcatacacctgtagtcacagctacttgggaggttgaggcatgaggatcacctgaacctgggaggggaggca

SEQ ID NO: 5221 - DNA, 377 bp, Homo sapiens
gctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaagagctccttagtaaaggacttatcaaactggtttcaaagcacagagctca

SEQ ID NO: 5222 - DNA, 462 bp, Homo sapiens
gcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcaacccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctataaaaggcacattgggtatcattcattacattcttgagttttttttgggttttttttttttt

SEQ ID NO: 5223 - DNA, 139 bp, Homo sapiens
gggcacctggaggcgtctgcagagtgtgcgcagttcttcagtatttagagcatcgatcctgcggtgatactcagccactgacactacctaaatatggagacaggaagacaataattccactgacagttgagaaaaacag

SEQ ID NO: 5224 - DNA, 140 bp, Homo sapiens
ggggtggtgcacagaggctgcagtgagtggagatcgcaccattacactccagcccgggcgacagtgcgagactccatctcaaaaaaaaaaaaaaaaaaaatttttttttttttccaccctttttttttttttttcccccc

SEQ ID NO: 5225 - DNA, 360 bp, Homo sapiens
cttccttgcgtcgtatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacg

SEQ ID NO: 5226 - DNA, 386 bp, Homo sapiens
  misc_feature 187, 254: n = A,T,C or G
gctttcacattcgggaagcgtcgggattaggtgaaagtacgtagttgtctttcgtaggttaaaatgataattgggccgaaacttactgccttacctaaaaggcagcgcagtcaggatattggtaggtcgggggcggctttggaaacccttaagtttacaagcatgcgcggacttgagtgctcattangtcgccgggcgtccacgtgcagccctggaccctgaaccccggcgtgcgtgggccgtgggccctcggngaaaggttccgtgcactcggggactccggtgaagcctgttcagccgtctgtgtcatgtggccatcttgagactactctgtcgctcttgtggcctagcaccccgagaaccgtcagtttgaaccagagggaaac

SEQ ID NO: 5227 - DNA, 431 bp, Homo sapiens; identical to SEQ ID NO: 4118

SEQ ID NO: 5228 - DNA, 207 bp, Homo sapiens
gtttcaccgttttagccgggatggtctcgatctcctgacctcgtgatccgcccgcctcggcctcccaaagtggctgggattacaggcgtgagccaccacgcccggccggagtaattttacaaaagagacttgttagtaactacctcatccaggttatcaaattaacatcaacagtgattaaagccagttgataccctgtgcccggga

SEQ ID NO: 5229 - DNA, 534 bp, Homo sapiens
cactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacat

SEQ ID NO: 5230 - DNA, 513 bp, Homo sapiens
gagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggattttttgatattcttaatgatccatcacaaagcgaagtcatgggagagccacacttgatggtggaatataaacttggtttactgtaatagtgtgc

SEQ ID NO: 5231 - DNA, 509 bp, Homo sapiens; identical to SEQ ID NO: 4129

SEQ ID NO: 5232 - DNA, 518 bp, Homo sapiens; identical to SEQ ID NO: 4130

SEQ ID NO: 5233 - DNA, 208 bp, Homo sapiens
caccatcatatatgcattttgttgttgaccgaaacgtcgttatatattctttccatacatagcatgtggaaagaatagatctcttttttttaattggtccacactttaccatataatggaatacgcaaaatttcacaatacctttcaggatgtaaaatacatataccctttgacgacattagaaaagagaaaatgtgggccgggcgcg

SEQ ID NO: 5234 - DNA, 474 bp, Homo sapiens
gcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagc

SEQ ID NO: 5235 - DNA, 357 bp, Homo sapiens; identical to SEQ ID NO: 4132

SEQ ID NO: 5236 - DNA, 324 bp, Homo sapiens
gggactacaggcgcccgccaccacgcccggctaattttttgtattgttagtagagacggggtttcaacgtgttagccaggatggtctcgatctcctgacctcgtgatccacccgcctcggcctcccaaagtgctgggattacaggcctgagccaccggcccggccaaatccctttatttttaatattgaggctttatactgaatttacaatagcatttgcaataatgtcaagtgtttcatcgacagagtgaacttccagaagctatactttgaaagtgtatgaaaaattacctcgttgccgttgggcgccgtggctcacgcctg

SEQ ID NO: 5237 - DNA, 340 bp, Homo sapiens; identical to SEQ ID NO: 4133

SEQ ID NO: 5238 - DNA, 436 bp, Homo sapiens; identical to SEQ ID NO: 4137

SEQ ID NO: 5239 - DNA, 321 bp, Homo sapiens; identical to SEQ ID NO: 1067

SEQ ID NO: 5240 - DNA, 352 bp, Homo sapiens
agccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccg

SEQ ID NO: 5241 - DNA, 508 bp, Homo sapiens; identical to SEQ ID NO: 4142

SEQ ID NO: 5242 - DNA, 503 bp, Homo sapiens; identical to SEQ ID NO: 4144

SEQ ID NO: 5243 - DNA, 488 bp, Homo sapiens
gctctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaattacaagttgtgcaaagtgagaaagatctttgtgggcacaaaaggaatccctcatctggtgactcatgatgcccgcaccatccgctaccccgatcccctcatc

SEQ ID NO: 5244 - DNA, 511 bp, Homo sapiens; identical to SEQ ID NO: 4146

SEQ ID NO: 5245 - DNA, 421 bp, Homo sapiens; identical to SEQ ID NO: 4149

SEQ ID NO: 5246 - DNA, 537 bp, Homo sapiens; identical to SEQ ID NO: 4150

SEQ ID NO: 5247 - DNA, 579 bp, Homo sapiens
gaatttggccctcgaggccaagaattcggcacgagggtcctgcggaagctgaaccaggagagcatcgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggctggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcacc

SEQ ID NO: 5248 - DNA, 327 bp, Homo sapiens; identical to SEQ ID NO: 4153

SEQ ID NO: 5249 - DNA, 411 bp, Homo sapiens; identical to SEQ ID NO: 1072

SEQ ID NO: 5250 - DNA, 246 bp, Homo sapiens
aatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtgt

SEQ ID NO: 5251 - DNA, 376 bp, Homo sapiens
cttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaacttcaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaat

SEQ ID NO: 5252 - DNA, 414 bp, Homo sapiens; identical to SEQ ID NO: 1076

SEQ ID NO: 5253 - DNA, 442 bp, Homo sapiens
ggttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaaggtgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaac

SEQ ID NO: 5254 - DNA, 376 bp, Homo sapiens
gcccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtgacccgcctgcaggattttaagcttgactttggcaattcccaaggcaaaacaagtcaaacttggcatggagggatagccaccatttttcagagtcctggcgatgaagtgtggggagtagtatggaaa

SEQ ID NO: 5255 - DNA, 297 bp, Homo sapiens
cacgccattctcctgtctcagcctcctgagtagctgggactacaggcgcccgccaccatgcccagctaatttttttgtatttttagtagagacgggttttcaccgtgttagccaggatggtctcgatctcctgacctcgtgatctgcccgccttggcctcccaaagtgctgggattacaggcatgagccaccgcgcctggcccattttcttcctcttttgaggtaatggatttgtttggagatggcatgttagtagacgactgattatggaaaggatatcgagttatctattttgtt

SEQ ID NO: 5256 - DNA, 356 bp, Homo sapiens
gggggcagaaagaagtatttccaacctagaaattctatatatacccagcgaaaatatctcttaaaaagatatccaaggctgggcgtgacggctcacgcctataatcccaatactttgggaggccaaggcaggtggataacctgaggtcaggagttcgagacaagcctggccaacatggagaaaccctgtctatactaaaaatacaaaaattagccgggcgtggtggcatgtgcctgtaatcccagctactagggaggctgaggcaggagaatcacttgaatccaggaggtggagattgcagtgagccaagatcatgccactgcactccagcctgggcaatggagcaagactctatc

SEQ ID NO: 5257 - DNA, 196 bp, Homo sapiens
gagaagacgacagaaggggaagctgccaaaaatccctacaaacggagggttgggccacctgtggccaccagaaaagccaaggttggggttggttcaccacccaatttccagttaaaaggcggattgggccgggaccgtggccagccacttaattaaaatgggaaaggatcttttggcttggattaaccttccggcc

SEQ ID NO: 5258 - DNA, 143 bp, Homo sapiens
tcattgaggtcataaggtttctgagacaactcaagagatgggattaaccttgggtgggaggaggaacggcttctgtaaactttgaattagtgaggtatctcactttggtggcttctattttctctgtaaagcatgaggccacc

SEQ ID NO: 5259 - DNA, 466 bp, Homo sapiens
gacattttctcggccctgccagcccccaggaggaaggtgggtctgaatctagcaccatgacggaactagaggcagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcacgtacctctgattaataaatgcttatt

SEQ ID NO: 5260 - DNA, 427 bp, Homo sapiens; identical to SEQ ID NO: 4178

SEQ ID NO: 5261 - DNA, 488 bp, Homo sapiens
ttttgagatggagtttcactcttgttgcccaggctggagtgcagtggtgcgatctcagctcactgcaacctccgcctccggggttcaagcgattctcctgcctcagcatcccaagtagctgggattacaggcatgcgccaccatgcccggctaatattttgtatttttagtagagacagggttgcaccatgttggtcaggctggtcttgaactcctgacctcaggtgatccacctgcctctgcctcccaaagtactgggattacaggcgtgagccactgcgcctggccaatatttttgacatgctgaatcctcactttatccacatcagtgaggtactacttgacaaaaataccccaacatttttggtttcttggtgacagtttacatcttaccatgtaaatgaactctgaataacaaattacttatgataaatgttaaattagtccatgatagttcctctggaattatttatcaagtaaaagatgag

SEQ ID NO: 5262 - DNA, 297 bp, Homo sapiens
gcttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatgggggggtaacagaaaggaactggctaccgttcggactatttgtagtcatgtacagaacatgatcaagggtgttacactgggcttccgttaca

SEQ ID NO: 5263 - DNA, 409 bp, Homo sapiens
gactcctgctcagcatggctgctttagtgactgttctcttcagtgtccggaggctgcactgcagcgcagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcg

SEQ ID NO: 5264 - DNA, 468 bp, Homo sapiens; identical to SEQ ID NO: 4185

SEQ ID NO: 5265 - DNA, 453 bp, Homo sapiens; identical to SEQ ID NO: 4186

SEQ ID NO: 5266 - DNA, 452 bp, Homo sapiens; identical to SEQ ID NO: 4187

SEQ ID NO: 5267 - DNA, 399 bp, Homo sapiens
tactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccccacaccactttttgattgggaatgctgaaccatttgagaagagaaacttggcttctgttttcgcaaaggaaaaaaaaaataggataggcttcccttgtgcagagggagaaatggttttgttttggttttgtttttaaatggagccctgagg

SEQ ID NO: 5268 - DNA, 411 bp, Homo sapiens
acagaagggtgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctag

SEQ ID NO: 5269 - DNA, 60 bp, Homo sapiens
tgaggggattcacttgtgtgcgggactcctcttaaccatgggggcccttttccttgcacc

SEQ ID NO: 5270 - DNA, 133 bp, Homo sapiens
cttaaaaatgtaatgtgggtgctggcccggcgcgggggctcacgcctgtaatcccagcactttgggaggcccaggcgggcggatcacgaggtcaggagatcgagaccatcctggctaacacggtgaaaccccg

SEQ ID NO: 5271 - DNA, 348 bp, Homo sapiens
gcttttcattcccgttgttatggagggccacatctgccagagcctggagtctgcgaaggccgggacccggctccccggtccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgt

SEQ ID NO: 5272 - DNA, 356 bp, Homo sapiens
  misc_feature 330: n = A,T,C or G
ggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctanagtaactgaagatccacaaaagaagg

SEQ ID NO: 5273 - DNA, 281 bp, Homo sapiens; identical to SEQ ID NO: 4188

SEQ ID NO: 5274 - DNA, 136 bp, Homo sapiens
ctacaagagcccctgcccctctgttggaggcacagttttagaataaggaggaggagggagaagagaaaatgtaaaggagggagatctttcccaggccgcaccatttctgtcactcacatggacccaagataaaaga

SEQ ID NO: 5275 - DNA, 351 bp, Homo sapiens
ggcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatactcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatg

SEQ ID NO: 5276 - DNA, 335 bp, Homo sapiens; identical to SEQ ID NO: 1082

SEQ ID NO: 5277 - DNA, 450 bp, Homo sapiens; identical to SEQ ID NO: 4193

SEQ ID NO: 5278 - DNA, 291 bp, Homo sapiens; identical to SEQ ID NO: 4194

SEQ ID NO: 5279 - DNA, 364 bp, Homo sapiens
acttgcgaggctgaggtgggaggatcacctgagcccaggaggtcgaggctgcagtgagcttgacagatctcatgacagggccttgctctgttgcccaggctggacagaatagatttaaattaaaatatatttctggccgggcgtggtggctcacacctgtaatcctggcactttgggaggctgaggcaagcagaccacctgaggtcaggagttcaagaccagcctggccaacatggtgaaaccctgtctctactaaaaatgcaaaaattatccgggcacgatggtgcatgcctgtaatcccagctactcggaaggctgaggcaggataattgcttgaaccccggagatggaggttttaatgatt

SEQ ID NO: 5280 - DNA, 365 bp, Homo sapiens
gcctcggcctcccagagtgctaggattacaggcgtgagccaccgcacccgtccgacaactcgatttttatatgaaaaggtaaccagggccaggcatagtggcttatgcctgtaacccagcattctgggaggctgaggtgggtggatcacctgaggtcaggagtttgagactagcctggccaacatggtgaaaccctgtctctactaaaaatacgaaaaattagctgggcatggtggtgggcacctgtaatcccagctactcaggagactgaggcaggagaattgcttgaacccgggaggcggagggttgaccctcctatactatgctactgaaattttagcctggattaatgtgtggagcactcg

SEQ ID NO: 5281 - DNA, 121 bp, Homo sapiens
ggacaaagggatctggacagaatcgccggacaggtggcagctgccaacaagaagcattagaacaaaccatgctgggttaataaattgcctcattcgcaaaaaaaaaaaaaaaaaaaaaagg

SEQ ID NO: 5282 - DNA, 398 bp, Homo sapiens
gtcttttcttaaacttttattttacgtttaggggtacatgtgaaaatttgttacataggtaaacacgtgtcatgggggtttgttgtacatattatttcatcacccaggtattaagctcagtacccaatagttatcttttctgctcctttcccttttcccaccaccctcctaccttttcattatctatgaaaaaatcatgttccaaaaagaataattgacttgcccaaggccatggctatagggctagttatgagcagtgctgggtctgcctatagattcctcacttcatgcatccacagggtagaagaaagtacttttttccttcattgtgatgcttccctgttattatcatccttatttttattattgacacatactgaaaaaaatttatgactgac

SEQ ID NO: 5283 - DNA, 502 bp, Homo sapiens
gtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtatcagggtctggagataaagtcaagtgaccagcctctgactgtgcctgtacctcccaaattctccactcgattccactgctaaactcagctgtgagctgcggataccgcccggcaatgggacctgctcttaacctcaaacct

SEQ ID NO: 5284 - DNA, 154 bp, Homo sapiens
cggagtgctgtgccacctggtgccgacaagaaagccgcggctgatgctgggtcagcaaccgaattccattttagaggcggatttggtcgtggacgtggtcagccacctcagttaaattggagaggattcttttgcattgaataaacttacagtc

SEQ ID NO: 5285 - DNA, 450 bp, Homo sapiens
gggcgaattgggtaccgggcccccccttgagaccccatgacctctagggtcacgcggaggctcctggggtcagactgagaaaggggctcgtcctgagaagccacaaagtgtgctcctgcgggggtgcggggtgggggaggtaccacgtctcccgggcagccacagatcccacactcacggcccatgtgacgcttggtgcagagctggaaggttctcagggtgggaggagggttatttttaacgcactgcactagagcatctctaaggccggtggttctggacagaaaaaccacaaaaatgagaagaccaggaatagcaagtccccagccctggggcctcatgtctgcaatgagcccttggtggctctgagcagtgccagttcagcaccttggagagctgccgcctctgtgcctcccctcctgcttgctgcgtgggggcttgtggagcctg

SEQ ID NO: 5286 - DNA, 691 bp, Homo sapiens; identical to SEQ ID NO: 265

SEQ ID NO: 5287 - DNA, 327 bp, Homo sapiens
ataccagataaaatactctttgactaccatgttaattcggggtaagcaaatgttctcatataggagttgacacttacccttgtactgcagtattccaagagaatgtcaatgttttctttgtcctcgaagtagtggtaaaactgcactacatgcttatgatgaagaattctgtgaagctctatttctttgtcaatcttttccctttgatgaggtttagctactctgctgtgaggaataattgttgcggcctagactttgttatttgacaaatatgtcatctcgtaacattttgcatagccaccctttgccagcactttgccccggcag

SEQ ID NO: 5288 - DNA, 600 bp, Homo sapiens
  misc_feature 566, 586: n = A,T,C or G
ctcgaagaatattttaatacattttaaaactcaacaaccttgtataaaaacctgtcgagtctgctggcacacgtggggctgggtggttgggggccggggctacgtgtggacagggctggtctggacgagtgggttggggcaagagggcatcgctcatcccaacacagaaacaggtctccagctccgaagattaaacaatccacccggctcccaccagttcctttccaaatcacggcccagccagccccgtgcgtgtcgagagtgggagagggtgtgtggaggtttgtgctgccccacgtgggcacccgaagatgccctggcaagtcacggagaaaacacagctctttcctccacaacaaggaaaatgatttaattctacaaatttacaaaccaaaatacaaaaacaaaacatggagcacaaagtaagacgaggagttcgagtctcatcgcagctccagccgcagtagccacgcctgtggtcccggctgagttctccccatgacggggtccactctgaccttcagaactgaggctgagcggggggccgcgcagagcccctggttcgntgtggtaaggtggagccgtntcttcagtcgtcgt

SEQ ID NO: 5289 - DNA, 914 bp, Homo sapiens
  misc_feature 845: n = A,T,C or G
ccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagaccttctgtcttcattttccaggaacttggtgatgatatcgtgggtgagttcattttccaggtgctgtagtttcccctcgtcaggcaggaagaagatggcggtggcattgccaggtatttcatcagcagcacccagctggacagcttcttacagtgctggatgttaaacatgcctaaacgcttcatcataggcaccttcacggtggtcatctggttcacgtggaagtcctcttcctcggtgttcctgacttcaaagggtctctcccatttgcctttatagaagatgtgattcatcagagcagaaactgtgtctctgtcagaggctcgggcaaaaccacaattttcctctggggacccttctcccggatagtgtgagattgtttctggcgctccggggtgccccagattttgaatgagagtgcttcggtggngaacattttttaatcctcccaaaaatcttatctattagttgaggcctctgtgtagagaaaagggcattg

SEQ ID NO: 5290 - DNA, 325 bp, Homo sapiens
gcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatc

SEQ ID NO: 5291 - DNA, 297 bp, Homo sapiens; identical to SEQ ID NO: 4202

SEQ ID NO: 5292 - DNA, 340 bp, Homo sapiens
gcttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttga

SEQ ID NO: 5293 - DNA, 510 bp, Homo sapiens; identical to SEQ ID NO: 4205

SEQ ID NO: 5294 - DNA, 435 bp, Homo sapiens; identical to SEQ ID NO: 4206

SEQ ID NO: 5295 - DNA, 459 bp, Homo sapiens
gaagccaagtgactcagtcatttcaggtgcaaatctcagtaatcgagataaacaatattttaatataatactttaaaaatcaatattgtggctcatgcctgtaatcccagcactttgggaggccgaggcaggcggaccacgaggtcaggagatcgagaccatcctggctaacacggagaaaccccgtctctactaaaaatacaaaaaattagccgggcgtggtggtgggcgcctgtagtcccagctactcaggaggctgaggcaagagaatggcttgaagccaggggaggcagagcttgcagtgagccaaaatcgcgccactgcactccagcctgggcgacagagcaaggctctgtctcaatattaatgcaaaaaacactatgtggcataacaactaaaggtaatgtagtccggaacaggaaagaacattatgtaaaaactaaggaaatatgaatagag

SEQ ID NO: 5296 - DNA, 480 bp, Homo sapiens; identical to SEQ ID NO: 1095

SEQ ID NO: 5297 - DNA, 416 bp, Homo sapiens
atcataaacattctataatactttatagtttacacaaagcattttcataagtttatctcatttaatcatcataacaaatctatgggacctagatatttatacctgttctacagatgaggagattaaagaagtttaagagccgggtgcggtggctcacgcctgtaatcccagcactttgggaggctgaggtgggcggatcacaagtcaggagatcgagaccatcttggctaatgtggagaaaccctgtctgtactaaaaatacaaaaattagccgggtgtggtggcaggcgcctgtagtcccagctgctccggaggctgacgcatgataatggtgtgaacccgggaggaggagcttgcagtgagccaagatcatgccactgcactccaacctggatgacagagtgagactctgtctc

SEQ ID NO: 5298 - DNA, 110 bp, Homo sapiens; identical to SEQ ID NO: 4208

SEQ ID NO: 5299 - DNA, 386 bp, Homo sapiens
tggcatcacggagggaggacgcctcggctggctggaagcggctcacctgctaaaaagccctcggagccaggcgcggtggctcacgtctataatcccagcactttgggaggccaagacgggcagatcacctgaggtcggggttcgagaccagtctgaccaacatggagaaaccctgtctctactaaaaatacaaaattagctgggcgtggcggcatgcgcctgtagtcccagctactcacgaggctgaggcaggccaattgcttgaacctgggaggcggaggtggcactgagccaagattgtgccattgcactccagcctaggcaacaagagtaaaactccgtcccaaaggaaaaaactacgaaccaaaagaaaaaattttttgggg

SEQ ID NO: 5300 - DNA, 495 bp, Homo sapiens; identical to SEQ ID NO: 1096

SEQ ID NO: 5301 - DNA, 314 bp, Homo sapiens; identical to SEQ ID NO: 4213

SEQ ID NO: 5302 - DNA, 505 bp, Homo sapiens; identical to SEQ ID NO: 4214

SEQ ID NO: 5303 - DNA, 67 bp, Homo sapiens
tggaccttgaacctaccagctgttgaactgaaccaggggggctctcctggtgctcatagccttcaaa

SEQ ID NO: 5304 - DNA, 55 bp, Homo sapiens; identical to SEQ ID NO: 4216

SEQ ID NO: 5305 - DNA, 315 bp, Homo sapiens
gactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccataaagcggcttatcgaacagagccgggagttcaagaagaacactccagaggatttgcgcaagcaggtagcgccgctgctgaagagtttcctaggagagattgatgcactgagtaaaagaagcaaggaagctgaagcagctttcttgaatgtctacaaaaagattgat

SEQ ID NO: 5306 - DNA, 437 bp, Homo sapiens; identical to SEQ ID NO: 4219

SEQ ID NO: 5307 - DNA, 360 bp, Homo sapiens
ggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggcttttttttttttttggggggaggaaaaaccacctccttgcccccaaaataataaaaaaggccccttggtttttttt

SEQ ID NO: 5308 - DNA, 440 bp, Homo sapiens; identical to SEQ ID NO: 4221

SEQ ID NO: 5309 - DNA, 297 bp, Homo sapiens
ggagagcgtgcggccgggtaagggagccgtcttctcagattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccgggctcctgccccatctgctggctgcgctggggttcaaaaacaagactgtccttaagaaacgctgcaaggactgttacctggtga

SEQ ID NO: 5310 - DNA, 204 bp, Homo sapiens
gccctttcctataacaggcctcaacggggcgggagccgccaaaatgaagtttaatccctttgtgacttccgacccaagcaagaatctcaaaaggcatttcaatgcaccttcccacattcgaaggaagattatgtcttcccctcttttcaaagagctgagacagaagtacaacgtgcgatccatgcccctcccaaaggatgatga

SEQ ID NO: 5311 - DNA, 223 bp, Homo sapiens
gtttgaaattttttcaaatgaaatgtatttttaaaatatagaaaacaaaaactggctgggcacagtagctcacgcctgtaatcccagcactctgggaggcccaggcgggtggatcatgaggtcacgactttgagaccagcctggccaatatggtgaaaccccatctctactaaaaatacaaaaattatctgggtgtggtggcacgcatctgtagtcccagcta

SEQ ID NO: 5312 - DNA, 315 bp, Homo sapiens
ataaccatgcacactactataaccaccctaaccctgacttccctaattccccccatccttaccaccctcgttaaccctaacaaaaaaaactcatacccccattatgtaaaatccattgtcgcatccacctttattatcagtctcttccccacaacaatattcatgtgcctagaccaagaagttattatctcgaactgacactgagccacaacccaaacaacccagctctccctaagcttcaaactagactacttctccataatattcatccctgtagcattgttcgttacatggtccatcatagaattctcactg

SEQ ID NO: 5313 - DNA, 362 bp, Homo sapiens
caagaaaacttacgaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgccatccccactttagtcacgagatctttttctgctaactgttcatagcctgtgtagggcccatgggttcttcatgggctatgatctctgaaaagacgttatcaccttaaagctcaaattctttgggagggtttttacttaagcccattaccaattcagg

SEQ ID NO: 5314 - DNA, 502 bp, Homo sapiens
agaggggatgtggtgagagccaggttcctctggccctctccagggtgttttccactagtcactactgtcttctccttgtagctaatcaatcaatattcttcccgtgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaattt

SEQ ID NO: 5315 - DNA, 333 bp, Homo sapiens
gagtcttggctgggagacctgtactccgtactccgtacttcgtagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatggtcaagcagtctttgtccatgaaactgggaggcgaccgtgttagctgccagttcctgacagccacctctcac

SEQ ID NO: 5316 - DNA, 514 bp, Homo sapiens; identical to SEQ ID NO: 1101

SEQ ID NO: 5317 - DNA, 426 bp, Homo sapiens; identical to SEQ ID NO: 4232

SEQ ID NO: 5318 - DNA, 485 bp, Homo sapiens; identical to SEQ ID NO: 4233

SEQ ID NO: 5319 - DNA, 527 bp, Homo sapiens; identical to SEQ ID NO: 1103

SEQ ID NO: 5320 - DNA, 521 bp, Homo sapiens
gggtacggctgcgcgaagacggcagaaggggggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagaggaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgac

SEQ ID NO: 5321 - DNA, 487 bp, Homo sapiens; identical to SEQ ID NO: 4238

SEQ ID NO: 5322 - DNA, 84 bp, Homo sapiens; identical to SEQ ID NO: 4240

SEQ ID NO: 5323 - DNA, 364 bp, Homo sapiens; identical to SEQ ID NO: 4241

SEQ ID NO: 5324 - DNA, 131 bp, Homo sapiens; identical to SEQ ID NO: 1105

SEQ ID NO: 5325 - DNA, 95 bp, Homo sapiens; identical to SEQ ID NO: 4242

SEQ ID NO: 5326 - DNA, 210 bp, Homo sapiens
acaaccggcattctgtctggaaaacgacatactggctgggatgcagaatactaccgaagggtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtac

SEQ ID NO: 5327 - DNA, 402 bp, Homo sapiens; identical to SEQ ID NO: 4243

SEQ ID NO: 5328 - DNA, 440 bp, Homo sapiens; identical to SEQ ID NO: 4244

SEQ ID NO: 5329 - DNA, 70 bp, Homo sapiens; identical to SEQ ID NO: 4247

SEQ ID NO: 5330 - DNA, 446 bp, Homo sapiens
tgggaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcacgcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaa

SEQ ID NO: 5331 - DNA, 401 bp, Homo sapiens
gactccgccttccacgtgcacccactgcctcttcccttctcgcttgggaactctagtctcgcctcgggttgcaatggaccccaactgctcctgtgccgctggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgatacaatcttgacccctttgctacattcctttttttctgtgaaatatgtgaataataattaaacacttagactt

SEQ ID NO: 5332 - DNA, 438 bp, Homo sapiens; identical to SEQ ID NO: 4249

SEQ ID NO: 5333 - DNA, 370 bp, Homo sapiens; identical to SEQ ID NO: 4250

SEQ ID NO: 5334 - DNA, 495 bp, Homo sapiens; identical to SEQ ID NO: 4254

SEQ ID NO: 5335 - DNA, 477 bp, Homo sapiens; identical to SEQ ID NO: 4256

SEQ ID NO: 5336 - DNA, 505 bp, Homo sapiens
gaagggggcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccg

SEQ ID NO: 5337 - DNA, 503 bp, Homo sapiens
gaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatcctttttttgtacatttaagaatattttgattatattaaacaagactgctgattttgctactttttttaaggggtcttcaagtaagtaaaacatacatcgtagctagaagaaaaatgtaccttaaatttgcatcttccct

SEQ ID NO: 5338 - DNA, 500 bp, Homo sapiens; identical to SEQ ID NO: 4257

SEQ ID NO: 5339 - DNA, 509 bp, Homo sapiens; identical to SEQ ID NO: 4258

SEQ ID NO: 5340 - DNA, 576 bp, Homo sapiens
gaatttggccctcgaggccaagaattcggcacgaggcaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagct

SEQ ID NO: 5341 - DNA, 460 bp, Homo sapiens; identical to SEQ ID NO: 230

SEQ ID NO: 5342 - DNA, 556 bp, Homo sapiens
gcacaggcactgccaggccgttctgatttccaggggccacgactgggggactggtggtttggagggatctgtccccagagggctggctgcagggctcattcacactgtcctgagactggctgggtgccagcggggtggaaggtgactcctcgagaggcttgtcagcattgaggcttggcggactcacctcagaggagttctgagtatggttctccagggtggaggcggcatccacggcgtcctcctcttccccctcatcccggccgtcttcgatctcttccatcacctcggccttggcctcagccaccagctcccgcagagccttgttactggtgatgctgctgacgaagggatgctccagcagctgcgcggcactgggtcgggtttctgggttcttatccagggctatcttcaggaagtcacggaactctacagaccacttggagggcgtgagcagcgtgggagggtccgacttggcgatctttagcaggacccgcatggggttgagctcgtggtgtggcggctcgatctgggccatctcaatcagcgtgatgcc

SEQ ID NO: 5343 - DNA, 495 bp, Homo sapiens; identical to SEQ ID NO: 232
  misc_feature 331: n = A,T,C or G

SEQ ID NO: 5344 - DNA, 943 bp, Homo sapiens
ccaaaagccttgtttttatttatatagagtcctaaccacttcggtgggaggaggagtgggagaggctcctttttcaatccagggacctccatgatgttggtttgttgttaccaaacacacaggtaagtggcatcacggatctggtaaactaacgacaatgtttagtctctctctgctagagcaacaaggtgagcatcaatctctgcttctgtaagaatcctgaatttaggattttcaactgtcactactccaacttctatttctgaaggtttgaaatcaattgatagaacagtagacaggcatgtaattgcagtttccactgtctgttcaaatgtccaatcaaatttcttcttcacttttttttcaaggaagctggttgactcagtttgtttaactcccgctgcagtggctttaaacccacagtagtaacctgcaggatcacacttatatacctgagggccttgctcttcatctataccaattaaaatcatacaacaaccaagagggctcatttcagcattctgtgtgtagacctgagaaatatcggcaattcttttacacagcatgtcacaggaatctcatagccatacttgtatttccagttagctgcctcataggaggcctctgtacctgggatctgctgtcagctgtcattacggtcatcacacaaccaatgttttcagtatcctggaaaagagaggcactgtgctggaatccataatttgttcaggaccttcctcctgggtgacaattaacggacagtcttttccctcgacaggcaatggatggaagggcaacccggttaattgagcttaaaagcaaattcctccttggggagccgccccccccgtggaaaaaatggtgatgtggcggtcaaaaccggcgctggaacacccgggaaatgttgggagaaaaaatacttttaaaaaaaatctcctgggcc

SEQ ID NO: 5345 - DNA, 655 bp, Homo sapiens
gaatttggccctcgaggccaagaattcggcacgaggagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccatgtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaaca

SEQ ID NO: 5346 - DNA, 694 bp, Homo sapiens; identical to SEQ ID NO: 4259

SEQ ID NO: 5347 - DNA, 440 bp, Homo sapiens
gaatttggccctcgaggccaagaattcggcacgaggataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgtttttttttttg

SEQ ID NO: 5348 - DNA, 502 bp, Homo sapiens
cgacagaaggggagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgct

SEQ ID NO: 5349 - DNA, 520 bp, Homo sapiens
gagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaac

SEQ ID NO: 5350 - DNA, 516 bp, Homo sapiens
agaagggggccgtggggcgggtatgggactagctggcgtgtgcgccctgagacgctcagcgggctatatactcgtcggtggggccgacggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctttctgagtgttaatgatgcctttgtgactggcgagtggggccgagcccacaaggcggaaggcaaggttcggctcctggctgatcccactggggcctttgggaaggagacagacttattact

SEQ ID NO: 5351 - DNA, 497 bp, Homo sapiens; identical to SEQ ID NO: 4264

SEQ ID NO: 5352 - DNA, 308 bp, Homo sapiens
tcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaa

SEQ ID NO: 5353 - DNA, 502 bp, Homo sapiens; identical to SEQ ID NO: 4265

SEQ ID NO: 5354 - DNA, 435 bp, Homo sapiens
cgattacattgcagtgaagggagaagtatgccaagtacctgcctcacagtgcagggcggtatgccgccaaacgccttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgct

SEQ ID NO: 5355 - DNA, 333 bp, Homo sapiens
gctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccacgatgaatgcgggtgttggaagtagaatatatatatacatataaaattgaaactggcgatggaatatgagaggagccctctggaaagaaaaggacagaccctgtgctttcatgaa

SEQ ID NO: 5356 - DNA, 156 bp, Homo sapiens
tgctaaaaaccatgctattcatgcacacaatggctgtatccccaaatctaatctttggctaaagatggggaggtatgtctctctcattcccacgagatttgcatatgacgacattaatacaaggttcctaaatgatatcccaagctctcagattct

SEQ ID NO: 5357 - DNA, 371 bp, Homo sapiens; identical to SEQ ID NO: 4273

SEQ ID NO: 5358 - DNA, 409 bp, Homo sapiens; identical to SEQ ID NO: 4277

SEQ ID NO: 5359 - DNA, 321 bp, Homo sapiens; identical to SEQ ID NO: 1112

SEQ ID NO: 5360 - DNA, 352 bp, Homo sapiens
gcaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcaggttatcctcataatggaatgatagacttaaa

SEQ ID NO: 5361 - DNA, 271 bp, Homo sapiens
gattacaggcgtgcaccaccatgcccagcttgtttttgtatttttaatagagatgaggtttcaccttgttggccaggctggtctctactgctgacctcaggtgatccactcaccttggcctgccaaagtgctgggattacaggtgtgagccactgcgcccggcctactacatacatttctaaaaaaaaaaatacattactaaaaaaaaaaggggggcttttttttaaaaaccccccctttaaaaaaaaacttgggggggggggaaaacccc

SEQ ID NO: 5362 - DNA, 239 bp, Homo sapiens; identical to SEQ ID NO: 1113

SEQ ID NO: 5363 - DNA, 147 bp, Homo sapiens
ctgtggactcacaaattttaccaaaaatcaaagctcttcctcatctccagggctacctgcgatctgtgtttgctctgacgaatggaatttatcctcacaaattggagtactgagtgtcttaagaacctaattaaatagctgactaca

SEQ ID NO: 5364 - DNA, 450 bp, Homo sapiens; identical to SEQ ID NO: 4281

SEQ ID NO: 5365 - DNA, 390 bp, Homo sapiens; identical to SEQ ID NO: 4282

SEQ ID NO: 5366 - DNA, 305 bp, Homo sapiens; identical to SEQ ID NO: 4283

SEQ ID NO: 5367 - DNA, 496 bp, Homo sapiens
gatcaatgtgaagagattccagaaaacactatatgtggaagaagttgttccgaatgtaattgaaccttccttcggcctgggtaggatcatgtatacggtatttgaacatacatttcatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggag

SEQ ID NO: 5368 - DNA, 320 bp, Homo sapiens
gtggtggctgctcttggcatgattaaaaaaatatggccaggcgtggtggctcatgcctgtaatcccagcaatttgagaggctgaggagtgtggatcacctgaggtcaggagtttgagaccagcctggtcgacatggtgaaaacccgactctgccaaaaatacaaaagttagccaggcatggtagcaggcacctgtaatcccagctactcgggaggctgaggcaggagaatcacttgaacccgggagatggaagttgcagtgagccgagttcacaccattgcactccaacctgggcaacaagagcaaaactgcatctcaaa

SEQ ID NO: 5369 - DNA, 247 bp, Homo sapiens
gggccttgctaactttatttcagaaagtggtaaaatagctatggagtacagacccagtgaagagattgtagatgtcagatgggaagaagaactacacgggttaatataagtatgtggagataaaaactcaaaggtgacagggccgggcacagtggctcacacctgtaatgccagtgcttttggaggctgaagcgggtggatcacctgaggtcaggagttcaagatcagactgaccaacatggagaaa

SEQ ID NO: 5370 - DNA, 50 bp, Homo sapiens
gtctgtcaaagcctatactaactttgatgctgagcgggatgctttgaaca

SEQ ID NO: 5371 - DNA, 139 bp, Homo sapiens
ccctgcctcaagcctcctgagtagctgggactacaggcacacgccaccacgcctggctaatttttgttttttgggttgatttgtttttttgagacagagtctcactctgtcacccaagctggagtgcattggtgtgatt

SEQ ID NO: 5372 - DNA, 526 bp, Homo sapiens; identical to SEQ ID NO: 2612

SEQ ID NO: 5373 - DNA, 478 bp, Homo sapiens; identical to SEQ ID NO: 4290

SEQ ID NO: 5374 - DNA, 93 bp, Homo sapiens
ggccacatggtgtcagatgaatatgagcagctgtcctctgaagccctggaggctgcccgaatttgtgccaataagtacatggtaaaaattttt

SEQ ID NO: 5375 - DNA, 524 bp, Homo sapiens; identical to SEQ ID NO: 4291

SEQ ID NO: 5376 - DNA, 293 bp, Homo sapiens
gagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaa

SEQ ID NO: 5377 - DNA, 489 bp, Homo sapiens
gacacgtgaaggtcggtgcggagttcgtctctgcaagcttggtcgccctgggatggattcctcctcctcttcctccgcggcgtgtttgggtgcagtggacccgcagttgcagcatttcatcgaggtagagactcaaaagcagcgcttccagcagctggtgcaccagatgactgaactttgttgggagaagtgcatggacaagcctgggccaaagttggacagtcgggctgaggcctgttttgtgaactgcgttgagcgcttcattgatacaagccagttcatcttgaatcgactggaacagacccagaaatccaagccagttttctcagaaagcctttctgactgatctcagcattacctctttggaaaaggaaggtagttcaagaaatgaagagctgttgatgggatgattgaagaaacagctatgagaggattggctcccatcttttgttactcttgggacatcctgtcatctgagaatgaacaaag

SEQ ID NO: 5378 - DNA, 86 bp, Homo sapiens
ccgctggagaagaccacagaagggggagatgccactttgaagaaccccatcctctggaatgtggctgatgtggtcatcaaattccc

SEQ ID NO: 5379 - DNA, 77 bp, Homo sapiens
gctcttcctaagccggcgctcggcaagttctcccaggagaaagccatgttcagttcgagcgcccagatcgtgaagcc

SEQ ID NO: 5380 - DNA, 360 bp, Homo sapiens
gactccgccttccacgtgcacccactgcctcttcccttctcgcttgggaactctagtctcgcctcgggttgcaatggaccccaactgctcctgtgccgctggtgtctcctgcacctgcgccagctcctgcaagtgcaaagagtgcaaatgcacctcctgcaagaagagctgttgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgatacaatcttgacccctttgctacattcctttt

SEQ ID NO: 5381 - DNA, 387 bp, Homo sapiens
  misc_feature 387: n = A,T,C or G
tacggctgttagaagacgattgaaggggagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtcttttgggagtcagatgaan

SEQ ID NO: 5382 - DNA, 51 bp, Homo sapiens; identical to SEQ ID NO: 2818

SEQ ID NO: 5383 - DNA, 111 bp, Homo sapiens
cagaagggagtcaccctgagagtgaaacagataccaagagagaatgaccctcacagctacagaaagaaatgaaatggggcaggagaagagggggaagaaagctaaataact

SEQ ID NO: 5384 - DNA, 362 bp, Homo sapiens
  misc_feature 324: n = A,T,C or G
ggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtggtcattcccaccacagccagatggtggccagcagtgcctggctgtctctctggactcctgtgttctgggtgctggngctggtttccaaacagagacaccccttctggtacgact

SEQ ID NO: 5385 - DNA, 353 bp, Homo sapiens
tccactatggcttccagcactgacccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtggccaccacaagatgtgccctgatggcagctgaagtttgattcagatgggcacttttct

SEQ ID NO: 5386 - DNA, 392 bp, Homo sapiens; identical to SEQ ID NO: 4293

SEQ ID NO: 5387 - DNA, 421 bp, Homo sapiens; identical to SEQ ID NO: 4294

SEQ ID NO: 5388 - DNA, 343 bp, Homo sapiens
  misc_feature 343: n = A,T,C or G
agtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgan

SEQ ID NO: 5389 - DNA, 336 bp, Homo sapiens
atccctgtacgggtgcctggcctcgcttctgtcccaccactctgcccaagaactggctggctccaggattggtgccttctcttatggctctgggttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtgga

SEQ ID NO: 5390 - DNA, 146 bp, Homo sapiens
tgggtcaaatagctccagcccagatagcacctgcttcaaaggcatctggcaagaaagcataagtggccacccttaaaaggtattaaaggttttttctgacctgttgcgaaaaaaaaaaaaaattaaaatataaaatctcgcatcgt

SEQ ID NO: 5391 - DNA, 137 bp, Homo sapiens
actaagagctgcatcctttaccgcacctgtttcatacgcgtctggccagatagcatctggctctgtcatggaaagtgatcctggctctttatcacctgccggggaaataaaaatgtggactgccaaaaagtcgtatc

SEQ ID NO: 5392 - DNA, 436 bp, Homo sapiens; identical to SEQ ID NO: 4298

SEQ ID NO: 5393 - DNA, 446 bp, Homo sapiens; identical to SEQ ID NO: 1121

SEQ ID NO: 5394 - DNA, 223 bp, Homo sapiens
acagaaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactac

SEQ ID NO: 5395 - DNA, 68 bp, Homo sapiens
agtaataaaggttctttctgacctggcgaaaaaatattaaaataaacagtgctggtaagtatgaagct

SEQ ID NO: 5396 - DNA, 556 bp, Homo sapiens; identical to SEQ ID NO: 4301

SEQ ID NO: 5397 - DNA, 65 bp, Homo sapiens
taacaacttcctgaaagcccttcaagagaaagtggaaattaaacaattaaatcatttctgggaaa

SEQ ID NO: 5398 - DNA, 590 bp, Homo sapiens
acgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtgggctgactctgcaaaatgggggtgtcccccgatcctggccgaggtgaggaacagacagggggggtctagattctgagggggttggtggatattgggcaaggcaggaaacctctggagacctcattttctccatgggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcac

SEQ ID NO: 5399 - DNA, 424 bp, Homo sapiens
aacaaccgagctccccaagtgagcaattcctgtcccttttaagggctcacaactctaagggtgtccgcttgagagggtcgtgatcaattgagcaagcaggggtacatgactgggggctgcatacatcggtaattagaaagaaactgaacaggacacggatcttcacagtgccttttttatgcaaataactgattaggtcaggggtcgatctttaactaccaggcccagggtgtggcaccaggttgtctgtttgtggatttcatttctgccttttagtttttacttcttctttctttggaggcagaaattgggcataagacaatataaggggtggtctcctcccttattccccccatttgagaatctcactcaatagtgggagttctcactttcatcctcactacccatgtcttcttgcaagaca

SEQ ID NO: 5400 - DNA, 69 bp, Homo sapiens
tagggcgaattgggtaccgggcccccccttgaggttttttttttttttttttttaaaaggaagggcttt

SEQ ID NO: 5401 - DNA, 513 bp, Homo sapiens
gtgtacacatatacatgttatcccaggatccacaaagcaaacagaagtggtaattgagcctagcaagcagtttagatggactacattcctcattccagctgaggagagatctcacaaggagaaaggagtgctaaggaagagcaagaccccacagccttccaaagatcccctatggtccaaagtcctttgaccatctcagtcagctgctttgttttctgttggcagtggagggacaaggtgagaggagccaggggtagtcatgaacaccagtgggttctgccctgggcagctccccaccttctttaagagagtactgtgtctcagctccagcagtctcaactgggaagacccaggactcctgctcttttctctaatccctgggagacgaggtccagctaaggtagagtaagcagtcagtgaccaggcaggctggtttgggaggtcactgcctggaggacgggatcttgtattcttcggaagatggctgggaaattcttcctccattacgtagac

SEQ ID NO: 5402 - DNA, 510 bp, Homo sapiens
aatgagatggagaagtactagcggatacgagtggtggggagaggtgccttcgggattgtgcacctgtgcctgctaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggtgggccagcctccttacagtggcctggctggagggcctcttacctctgggacaggcagacacaaatcttctggcttccctccttggaatgggcatggccaagggttagagttctggtcccaattatctgaccccggctagccccttgtcctctctggtcccagtgccctgttccatacataaaatgataggggttgttggctgggcacagtggctcatgcctgtaatctcagcactttgggaggccaact

SEQ ID NO: 5403 - DNA, 424 bp, Homo sapiens; identical to SEQ ID NO: 4304

SEQ ID NO: 5404 - DNA, 453 bp, Homo sapiens
tggctcacgtctgtaactccagcacttcgggaggccgaggcggatggatcacctgaggtcaggagtttgagacgagcctggccaacatggtgaaaccctgtctctactaaaaatacaaaaaattagccaggcatggtggcgggcgcctgtaatcccagctacttgggaggctgaggcaggagaattgcttgaacctgggaggcagaggttgcagtgagccgagatcgcaccactgcactccagcctgggcgacaagagcaagactccgtctcaaaaaataaacaaacaaataaaggtcaaagaaaatatctcagcaggacataccttaagaaattactagataattaatactcaggccaagaatgaaattggaaaacaaacaaacaaaaaaaacatgatattaaacaagaacatctcataaaacatcataatcaacagtaaacgtgggatgca

SEQ ID NO: 5405 - DNA, 343 bp, Homo sapiens
tcttatttttaatttaaggatttgcagctgtaagcttgcctttaacatgggttcgagatctttcttctttttaattaaaggatctgcagctgaaagctttcctttagcatgggttcgagatctttcttctttttaattaaagcatctgcagctgtaagcttccctttagcactgcctttgttgcctcctactgagtttgggtatgtcatgggtttgtgttcatttgcttaaacattttttagggctatagtaatataattgtgctgttgttaataaaggtaattaatgagacacataatgaattgtactactgattttataatattctaagcattcttaactc

SEQ ID NO: 5406 - DNA, 520 bp, Homo sapiens
gctctctgctctcgcggccgactcgcaagatggcgccgcagaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaggctccccttacagggctttgcttattaataaaataaatgaagtatacata

SEQ ID NO: 5407 - DNA, 486 bp, Homo sapiens
tgacattttggtatctttcatctgaccatccatatccaatgttctcatttaaacattacccagcatcattgtttataatcagaaactctggtccttctgtctggtggcacttatagtcttttgtgccataatgcagcagtatggagggaggattttatggagaaatggggatagtcttcatgaccacagataaataaataaaactaagctgcattgtgggttctgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgttcgtctgaagaaaggaaagaggaaagcaaatacgaattgtactattt

SEQ ID NO: 5408 - DNA, 313 bp, Homo sapiens; identical to SEQ ID NO: 2822

SEQ ID NO: 5409 - DNA, 505 bp, Homo sapiens
tgctattgctgtatggctgggagctaccagactggacaacacagatagagaagcctcatagcatcccataaagttgcattgaaatgtgctgatcaagggcaggagtgcaagaccagcctggtcaacatggtgaaaacctgtctctactaaaaatacaaacatgagctgggtgtggtggtgtgcacctgtaatcatagctacttgggaggctgatgcatgagaatcgcttgaacccaggaggtggagattgcagcgagccgagattgcgccactgctctccagcctggagacagagtgagactccatctcaacaaataaaaacaaaaaaggaaaagtgctggtccagcacatcactaagcaagcattaaaattgagaatgcctagtctgggcgcagtggctcatgcctttaatcccagcactttgggatgccgaggcgggtggatcacgacgtcaggagttcgagaccagcctggccaatatggagaaactccgtctctactaaaa

SEQ ID NO: 5410 - DNA, 453 bp, Homo sapiens; identical to SEQ ID NO: 4307

SEQ ID NO: 5411 - DNA, 510 bp, Homo sapiens; identical to SEQ ID NO: 4308

SEQ ID NO: 5412 - DNA, 377 bp, Homo sapiens
agaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttct

SEQ ID NO: 5413 - DNA, 347 bp, Homo sapiens
gttacaggtacctgccaccacacccagctaatttttgtattttagtagagacggggtttcaccatgttggccaggctggtcttgaactcctgacctcaggtgatctgcccgcctcggcctcccaaagtgctggggttacaggtgttagcccaccgtgcccggcctcttttttttttcgtacaatggcccattctgttgccccggacgacattcgatgcccctgtttacagttctttgcctccactttctgctagtgttttgtttttgtcagcctcccccctgcccgagagaatataatatagtttgttccgcacccgcgaaaccataactcccttttatttggttgc

SEQ ID NO: 5414 - DNA, 341 bp, Homo sapiens
tgagcactctgtcactagggtatataagccaggatggacacagggaaggacatttctgcatcagtggtgggtccccatcagttaagagagcctgtgactctgtcgagggaccatggggggtggcaccagagcccagggcacctgagggcctgtctggatgcagctgctagtggtcataggacagcaaacactattcattggattctgacttaggcaggtaccctgccgagtgccttaaaggtgtaatctcagttactcttcacagtacattaaaaaaatagttggctgggtgcagtggctcaggccaggcgcggtggctcatgcctgtaatcccagcactt

SEQ ID NO: 5415 - DNA, 312 bp, Homo sapiens
tggatcacctgaggtcaggagttcaaaaccagcctggccagcatagtgaaaccccatctctactaaaaatacaaattagccaggtgtgttggtgcatgcctgtaatcccagctcttgggaggctgaggcaggagaatcccttgagcctgggaggtggaggttgcagtgagccaagatcgcacaattgcactccagcctggacaacaagagtgaaactcccatctcaaaaaaaaaaaaatttaacttcgctcatcataaaagcgaattaaaactgatataccatttttcacctttcaaatccgcaaaagccaa

SEQ ID NO: 5416 - DNA, 451 bp, Homo sapiens; identical to SEQ ID NO: 1136

SEQ ID NO: 5417 - DNA, 307 bp, Homo sapiens; identical to SEQ ID NO: 4314

SEQ ID NO: 5418 - DNA, 488 bp, Homo sapiens; identical to SEQ ID NO: 4315

SEQ ID NO: 5419 - DNA, 316 bp, Homo sapiens; identical to SEQ ID NO: 4316

SEQ ID NO: 5420 - DNA, 384 bp, Homo sapiens; identical to SEQ ID NO: 4317

SEQ ID NO: 5421 - DNA, 379 bp, Homo sapiens
cttagttttctttatgtggtgaatcccatttattgatttgcatatgttcaaccatccttgcattcctggaataaaccctacttgatcatgatgaattatctttttaatgtgcttttaaaggacacaagaacaccagtggagtgttgaagcctcccactagtgtattgctcaggttcttaggtttagtagtagttttttttatgaatccgggtgctctgatgttgcgtgcatgtatatttaggatagaccttgatgactgtgtgccttggtgatgttcatcttgcatagcatctctcaagtgttctctgaatttcttgtatctgggtgaaaaacatggaacaattcatgaattcacatatcatccttgcatcttatagcc

SEQ ID NO: 5422 - DNA, 200 bp, Homo sapiens
ccagctacttgggaggctgaggccggagaatcacttgaacccggggggcagaggttccagtgagccgagatcctgccactgcactccagcctgggcgacagcatgagactccgtctcaaaaaaaaaaaaaaaaaaaattggccgggggggggggtttatcccctgaacccgggacttttgggggggcgggggggggggaa

SEQ ID NO: 5423 - DNA, 493 bp, Homo sapiens
gggcctcctttgttactagtttggagcagatccttgcagacgttttcctctgcattcacatgcatgcaaatgtacttctgaatgcgcacgtatgtctttatatacagatagcttttaacaaatagcaggtggggccggcactgtggctcacacctgtaattccaggactttgggaggctgaggcggggggatcacttgaggccagaagttggagaccagcctggccaacatggtgaaacaccatctctactaaaaatacaaaaattagctgggcgtggtggcgggtgtctgtagtcccagctactcaggaggctgaggcaggagaatcgcttgaacccaggaggcggaggttgcagtgagctgagattatgccactgcacgccagcctgggtgatagagcaagactctgtctcaattaaaaaaaatatgtggggccaggcaccgtggctcacacctgtaatcctagcacttttggagactgaggcgggtggat

SEQ ID NO: 5424 - DNA, 516 bp, Homo sapiens
ggcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 5425 - DNA, 639 bp, Homo sapiens; identical to SEQ ID NO: 1137

SEQ ID NO: 5426 - DNA, 500 bp, Homo sapiens
tgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtc

SEQ ID NO: 5427 - DNA, 399 bp, Homo sapiens; identical to SEQ ID NO: 1138

SEQ ID NO: 5428 - DNA, 401 bp, Homo sapiens
ctggagaattttgtcaactacccacctggggatgaagctcactggccacaatacccacctctgtggatgatgttgtatgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggc

SEQ ID NO: 5429 - DNA, 447 bp, Homo sapiens; identical to SEQ ID NO: 4319

SEQ ID NO: 5430 - DNA, 209 bp, Homo sapiens; identical to SEQ ID NO: 4321

SEQ ID NO: 5431 - DNA, 462 bp, Homo sapiens
taagctcgggaattcggctcgggaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacat

SEQ ID NO: 5432 - DNA, 571 bp, Homo sapiens; identical to SEQ ID NO: 1143

SEQ ID NO: 5433 - DNA, 502 bp, Homo sapiens
agctcggaattcggctcgagccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttga

SEQ ID NO: 5434 - DNA, 497 bp, Homo sapiens; identical to SEQ ID NO: 4324

SEQ ID NO: 5435 - DNA, 458 bp, Homo sapiens
tcaaggttctccataggttcttcgagataagcttaaagctgaatttcctgtgtgtttcaggcattcacagataaactcattctctgtacttctagggtagcatctttatgtatctattatgtacctcttatctattgtgttatcatctctgttatagaagagccttctgtagaccatatagaaaaagattatagaggaggagaatctactgctggcaattgggaaccgcaaggtatactaaataatatatcaacaactaatggccatctaatgctatgctggatatgaacttttggggcctcaggaaagaaaaaccaggaactagtttcaataatgaggtgtcatggttccctgtggcaaatttagaacgcttatcgtttggcaggacacagagaggtaggtgaacattccaggaaagaagcagcttagagaaaatgtggaggaaataatatgacact

SEQ ID NO: 5436 - DNA, 543 bp, Homo sapiens
ttttttttttttttttttttttaagtctggctctgtcacccaggctggagtgcagtggcgtgatctgcaacctctgccccccgggttcaagcgattctcctgcctcagcctcccgagtagctgagattgcaggtgctcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatctcactgaacctgtttgaaataaagctttctttctttttcatgattcgcctttgagtacctccacgctgaaagactgttgtaccactaaaaacttaaaggcacaaattctccttgaagaccttctcccttttatgtggccccatattttatgttgctttatctttggaattttgcatgaaaaggaaatgaatgga

SEQ ID NO: 5437 - DNA, 152 bp, Homo sapiens
ttttttttttttttttcccattaaaaaaactttattttctttttttacaaaaaatatccccatctggggtaaaaatatatttggttaagtccaaaatatagtctttcccttccaaaaggatccttattccaaaaccttgaaaccaccctttt

SEQ ID NO: 5438 - DNA, 491 bp, Homo sapiens
tggtggtgtgtgcctgtagtcccagctacccaggaggctgaggaaggagaatcgctggaacccagggggcagaggctgcagtgagccgagattgcaccaccgcactccagcctgggtgacagagcaagactccatctcaaataaataaataaataaagtgaaaatatactgcaggaaagaaaagttcatttcatgtgctgaatacacagcatgtgaagagggtcctgagaggggctaggggctttgaatatcacatttcatccagtgcttggaacattggaagatagtattgacttaaatgtttgcagtcaccgtgctatgtactatgcaccaggcattgtgtacactgattgactgaccatgccatatgagatattcaggggacagcaagcttgactaagccacagagttgcaatgcactgcctcaattttctcatttcctcagacgaagatgctgagccaatgtttaaagtgattataatgtgactttc

SEQ ID NO: 5439 - DNA, 487 bp, Homo sapiens; identical to SEQ ID NO: 1147

SEQ ID NO: 5440 - DNA, 392 bp, Homo sapiens
tttttttttttttttttttttttttgggagggagtctcgcttagattgcctaatctcagctcattgcaacttctgcctccggggttcaagggattctcgtgtctcagcctcctgggtagctaggatacaggcacccgctaccatgcctggctaattttggacttttagtagagacagggtttcgccacgttggccaggctggtctcgaactcctgacctcaggtgagccgcctgccttggcctcccaaagtgctgagattacaggcgtgagccaccgcgcttggcctaatttgcttctcctgaaattcaaatggtctaatatgaaaaacgccaaccttgcttgaaagaataagaaagaggtgcggtttcgttgggccgttgatgtttggaac

SEQ ID NO: 5441 - DNA, 303 bp, Homo sapiens
tttttttttttttttttttttttttgcaaatgtgtcagtttattaaaaatgcagcatttttcacatgagctttaaagatgtggaagatggggtacgattaaaaccatgagagttgtgcagggaacagccgtagggcctgtttgcaccttcagatattgcctgctcccaaaaattcagacccccagatgcagggcaagacaataagaaagggtgagtgcaagcaaggagagcctcctgctaagaggctgaggtcccctctggttccaaggatgggatgtcagccttgaccttccggggtctgca

SEQ ID NO: 5442 - DNA, 255 bp, Homo sapiens
accccagaagttgacaaagactcctccaaacttctcatttaacatctcatggatgtttgaaaacataacataatctgtgatatttcttctgtcgctagtcactgtgtttaaattttaaagtagtgaattgtgaccagtgttaatccaaagaagaattaagaattatttttccctcacacctggaatggcagtgaacatggctggagttgattggctgtgagtgccttgggctctatgagagattcattaggggat

SEQ ID NO: 5443 - DNA, 533 bp, Homo sapiens
catttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgcatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacacaacaatttgaagcttctgtaattttgagcactgctctaacaacaagcataatataaaattagttagattttgcaagtctacaaatgagctcttgcaacagaactcacagcctttttacttttttcccctaac

SEQ ID NO: 5444 - DNA, 285 bp, Homo sapiens
tttttttttttttttttttttttggatttaatgctttattgctcttgatggcaaatcaaaatatgttttagaaataaagttaatttactggaaaataggagtttttgcaccaaaccataaaattgcatttcattacatcaagagaacaccctcattgtctacaatcatgcccgcttcctttcccctcagcgcccggggcacgtgaccgagatcataccctaaattcctgatccttttgcagttgccacatactgtggcttttagtacatcataaaaaagtgcttt

SEQ ID NO: 5445 - DNA, 486 bp, Homo sapiens
attgtaatactctatttttactgtaccttttctatgtgtagatatgttaggtacacaaataaataccattgtgttacagttgtctgcagtattcagtacagtaacatgctgtgcagggttgtaggctaggagcatcaggctgggccatctatcctatgtgtggagtaggatgtgcacctatctttgtgcaagtgtactctgcgatgttcccacagtgacgaaatcacgtaacgatgcatctctcataacctgtccccatccttaagtgatgtatgactgtgttgaaaggctcttaattggatttgggaactctgtctcatagggatgtcatgaggattagtgactctttgtatttattgatccatttgagccttacagcaattctttgtagtaactcttcagcctctggtagatctgccagtccaccaactgtcttccagtatctctccattaattctttctgttttcacttcccttcctgtctat

SEQ ID NO: 5446 - DNA, 549 bp, Homo sapiens
ggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagatgacatttgtcaaactcaacaaattgaaggttaacaccttaagagttgtagttactgaccagaaatatggacagacttcttaaacttggaggaggtatgcctggactgggccaggggccacctacagatgctcctgcagtggacacagcagaacaagtctatatctctcccctggcactgttaaaaatgttaaaacatggccgtgctggagttccaatggaagttatgggtttgatgcttggagaatttgttgatgattataccgtcagagtgattgatgtgtttgctatgccgcagtcaggaacaggtgtc

SEQ ID NO: 5447 - DNA, 612 bp, Homo sapiens
tttttttttttttttttttttttttgggagcatagtgagtggagtttatttttataatttgtagaaaattgacatttagatttcaaaacttatattacaaaattatcagcagcagtcttaagcatttcaacaatgctgatagattccactttgctaacacaaacaaggctattataccatgttcgaaaagcaagacttgttccaagagggcctattattatacatctgcctcactgctcaggacccgtttgtgactgtgtcttcttccatctcttcttcaccatcatcagtgggccctgatctgcgttctctgccagggatctgaccagactgcagcaaccccttcagcccccccacttcagccagagttgaagcatttgctatggcattcttgattgcttctacatcccctggagatggcccacctttctttttgtcagttggcaaaccagcacctggattaaaagttttgcttctcctggcaatatcctttgcaagctgtgcaccccgttcgcccttgaacattttctctgcttcctgacgctcttttagtttcactttctggaaatccagtactctgacttgcggaactttataaatcacatacaatct

SEQ ID NO: 5448 - DNA, 456 bp, Homo sapiens; identical to SEQ ID NO: 1150

SEQ ID NO: 5449 - DNA, 486 bp, Homo sapiens; identical to SEQ ID NO: 1151

SEQ ID NO: 5450 - DNA, 610 bp, Homo sapiens; identical to SEQ ID NO: 2602

SEQ ID NO: 5451 - DNA, 644 bp, Homo sapiens
tttttttttttttttttttttctcttcgttttctccttgcctcttttttcttcttattaagcaaagatcttttggtggcttcatcccaattgctgacaaacgaggaaaagatgggaagtgcagccgatttctcagttttcacaaacaggagtttcacgctctcccacttctctggcaatttttctgaaagtcctttggtgacagcaacaatgttttcaatgatgtgctcaatttgcattccaacgtgaccaatacgtatagcactgcaagaaccacttttagaaatgtttaagaccgttccacctatacagtcattgatctctcttgataaattcttggacagaaggtttacagatactggaaccttctttctttgatagaaatgtctcccaatgagtgagggtaagagccgcctaattctggcatcagtaaggaagaaatcaaaactgctcagaaggcggagcttggcttcataggatttatattccttctttagagtttggagggagataatctgagaaacggttttaattccatgcttgtttaaaagctttctataaaactgttctgtcttttcaggagttgaattgggttcatccttcgtaaataaacagatatcttctgaatctgatcgaatactatga

SEQ ID NO: 5452 - DNA, 531 bp, Homo sapiens
catcactaacctgacagtcgttgccaggaatttgctttgtttactgctagtatattagaaatcctagatctcagaatcacaatagtaataaacaacagggggcattttttcctaacttactctgtgttcaggtgtggaatttctgtctcccaagaggaaatgtgacttcactttggtgccaatggacagaaaattctacctgtgctacataggagaagtttggaatgcacttgatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaaaatatatatatagggccccaatccattgccatcaaattgcccttggacttttccaaggtatattatggggttttatgcaaaattccaagctaccatgtaactttttttaaccatttaacaaggagggggaactgtttcctaccttctttacatg

SEQ ID NO: 5453 - DNA, 611 bp, Homo sapiens
ttttttttttttttttctttttttttgcaatatttctccactttattaacgctgaccaccatatttatgtatctaaacattttttataagttttcagtggtgtctagattctgaattatttttccataattaattaggcacgttggtttgtattttatagagaacacatctttaggacacagataagaacaagtataatttgcaaatattacaaagatgatttccaaatctcagttgacctctttcccaactgcaaaccctcatttagtctttagtgacaacagagaccaaaaacaaccacccacacatctcatgtgagattctggtggcttagaaatccctgaaagagcagtaaactgattattgaaaagctcagaacactggcaaggcttaagtgcaaagtatttaatagaaggccacaagaactgttttcctaagaggagctaggaactacaaatgtcatttagtaatgcattgaaatggcattgcctagtgtgagtgttgcacagaaacttcaggtcacttcttctggatctattattttggataagcttccactatcatagcatggccctgccctccagctgcacacgcagccactaagccatact

SEQ ID NO: 5454 - DNA, 61 bp, Homo sapiens
agtccgctcgcgtcacctcctcacgctgccgctgtcgcccgtgtaccgccggcccattccg

SEQ ID NO: 5455 - DNA, 706 bp, Homo sapiens
ggggagctgggaggcgcgacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctg

SEQ ID NO: 5456 - DNA, 642 bp, Homo sapiens
acggccgggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatactacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggc

SEQ ID NO: 5457 - DNA, 629 bp, Homo sapiens; identical to SEQ ID NO: 1155

SEQ ID NO: 5458 - DNA, 610 bp, Homo sapiens
gtcattttatactctgtataaaacttagctctaaagcagaaactaaagcagcaaatgcaggaaggctgtctcgccatcctcaagactcagcagctctcattctccagtggtgagcacaccatttgtgcagctgctgttgtcgtgaaatataacaacagtggaagtcacaaaaatgtcccctgcccagccccctcgccgcccttgacttcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctg

SEQ ID NO: 5459 - DNA, 649 bp, Homo sapiens; identical to SEQ ID NO: 2977

SEQ ID NO: 5460 - DNA, 607 bp, Homo sapiens; identical to SEQ ID NO: 2726

SEQ ID NO: 5461 - DNA, 604 bp, Homo sapiens
ggtccggtttccggcgggaacgtgggccgccagactcgggagaggctccgtcttgtgcaagggtcctgtgggctggctgcactggcctctgggtggtgcctgccagaatgccccacttggaaaacgtggtgctttgtcgcgagtctcaagtgtccatcttgcagtccttgtttggggagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcg

SEQ ID NO: 5462 - DNA, 578 bp, Homo sapiens; identical to SEQ ID NO: 1157

SEQ ID NO: 5463 - DNA, 641 bp, Homo sapiens
tcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacgccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatg

SEQ ID NO: 5464 - DNA, 462 bp, Homo sapiens
tgacattccggaaattcataccgaagtgcagcaagattgtcattgactttgattcaattaacagcagaccgagtcaaaagcttcagtgagttacatctcgttcaatctccagaagattgggattatcgtcttctaagaggttgctaatgcctttcatcttgaagttacacataacttcttactagccagtatggcaaaagtaggcatctaaagaatataaagcctcaaatcttccttaccgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagtatcagctgtctgtcatctgctgcgatccggcagcctctcttcactgctacatgtgctggaaggac

SEQ ID NO: 5465 - DNA, 506 bp, Homo sapiens
tccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgccctcaggcctctctgctcctgtcttttgtttggatgccggcgctgctgcctgtggcctcccgccttttgttgctaccccgagtcttgctgaccatggcttctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacag

SEQ ID NO: 5466 - DNA, 572 bp, Homo sapiens
actgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctaccccacgcctcttcccacttgcctggactgtgctgctccttccacttctgctgctgcaaaccccgtgaaggtgtgtgccacgcctggccttaaagagcgacaggctgaagagagggacaggcactccaaacctgtcttggggccactttcagagcccccagccctgggaaccactcccaccacaggcataagctatcacctagcagcctcaaaacgggtcaatat

SEQ ID NO: 5467 - DNA, 522 bp, Homo sapiens
tagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagag

SEQ ID NO: 5468 - DNA, 421 bp, Homo sapiens
tgggaatcggagtgggcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattaggtcttgagggcagagccctcacgaatggggttaaggcccttataagaagagacatggggccaggtgcagtggctcacacctgtaatcccaacattttgagaggccgagaagggtggatcatgaggtcaggagatggagaccatcctggccaacatggtgaaacctcatctctactaaaaatacaaaaatt

SEQ ID NO: 5469 - DNA, 510 bp, Homo sapiens; identical to SEQ ID NO: 2619

SEQ ID NO: 5470 - DNA, 328 bp, Homo sapiens
actacctgcaggtcgagagcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattaggtcttgagggcagagccctcacgaatggggttaaggcccttataagaagagacatggggccaggtgcagtggctcacacctgtaatcccaacat

SEQ ID NO: 5471 - DNA, 304 bp, Homo sapiens
tttataatttatttagctttttaagctgttcttagcaagatattggcctgcttcaaactagttcattttacctaagtgcagacaatttcctattattattattattgtcatttatttttgcagagataggatgtgactttgttgcccaggcttgtcttgaactcctgggctcaagtgatcctcctgctttgaccttccaaattattaggattacaggcatgagccactctagctggcgcctgtcattttttaaaggtatgcagaatacccaatatttatgagctgttttatgtagtgttcttta

SEQ ID NO: 5472 - DNA, 552 bp, Homo sapiens; identical to SEQ ID NO: 2746

SEQ ID NO: 5473 - DNA, 345 bp, Homo sapiens
gccgggggaaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacctcttcgttaaaaaaaaaaaaatttactttttacaattctggaggccaggaaaaccatgatcaggtgccagcatctgggaagggccttcttgctgtcctcccatggcaaaaaatggaagggcaagggaaagctaacatgctcccgcaaaccctttttataatggcatcaatcaaatatgaggccaaagt

SEQ ID NO: 5474 - DNA, 196 bp, Homo sapiens
aggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgt

SEQ ID NO: 5475 - DNA, 577 bp, Homo sapiens
ggcaacagtagttctaggaggagacaccatgggccctgagcgtatcttccccaatcagactgaggaactgggacatcagggcccttcagaaggcactggggattggagcagtggggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaac

SEQ ID NO: 5476 - DNA, 558 bp, Homo sapiens
ggtgaaatgcatccctcctgtgactggattggagacacaagaacagaaacatcctgatctctctactctactgtgcaggcttatgtactcataaaatggcagttatggacctatcctccccatgggctttaactaaacaggactctgcctgtttccatctgagaaatgctgaagaggaaaggatgattgctgtatttctgacaacctggttacaggaaccaatgactttcaaagatgtagctgtggagttcactcaggaggagtggatgatgctggattctgctcaaagaagtctgtacagagatgtgatgttggaaaactatagaaatctcacctccgtggaatatcagttgtacaggcttactgtgatctccccattggatcaagaagagataaggaatatgaaaaagagaattccccaagccatctgtccagaccagaagattcaacctaaaaccaaagaatcaactgtgcagaaaattttgtgggaggaaccatccaatgcagtgaaaatgataaaactcacaatgcataattggtcctccacattaagagaag

SEQ ID NO: 5477 - DNA, 579 bp, Homo sapiens; identical to SEQ ID NO: 1169

SEQ ID NO: 5478 - DNA, 619 bp, Homo sapiens
aacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaggtcctccatcctgctggatgtcaagccttgggatgatgagacggacatggcccagctggaggcctgtgtgcgctctatccagctggacgggctggtctggggggcctccaagctggtgccccgtggctacggtatccggaagctacagattcagt

SEQ ID NO: 5479 - DNA, 619 bp, Homo sapiens; identical to SEQ ID NO: 1170

SEQ ID NO: 5480 - DNA, 380 bp, Homo sapiens
tgccatgaagatgctgcatgtcagagcagtggctgttcctgctggagaatgtggcctcgagcagcaaagctagggtggcagtgaaaatcgaagaatggaccaggcatggtgactcatgctggtaatcccagcactttgggagtctgaggtgggtggatcacctgaggtcgggagttccagaccatcctgaccaacatggtgaaaccccatctctactaaatacaagaaattagccaggtttggtggcacatgcctgtaatcccagcgccttgggaggctgaggcaggagaatcgcttgaacctagaaggcggaggttgcagtgagccgagattgcaccatttacactccagcctgggcgacaagagtgaaactctgtctc

SEQ ID NO: 5481 - DNA, 442 bp, Homo sapiens; identical to SEQ ID NO: 1172

SEQ ID NO: 5482 - DNA, 573 bp, Homo sapiens
caacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttgg

SEQ ID NO: 5483 - DNA, 517 bp, Homo sapiens; identical to SEQ ID NO: 1173

SEQ ID NO: 5484 - DNA, 534 bp, Homo sapiens
gaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctg

SEQ ID NO: 5485 - DNA, 616 bp, Homo sapiens; identical to SEQ ID NO: 1174

SEQ ID NO: 5486 - DNA, 631 bp, Homo sapiens
tgaaatcttggtactgtggcttggtgggctatgttgaccttggagaatttctatcctctctaccacctcagtctccccacataacaaaattccactttggaaggtggagctaatatgaggactaaatgagattatttgtaaagtccccagcataatgtctcatatgtagcaagtgtctagtcaatgtctatgcttattagagggcctgcccatgagtctctgtttaaactgtgttggctggcactggggacatccttgtggtaggagtagactcctcagaagcaggatcatggttgggagccccaggctctggagttacatggccacaggtcaaatcctggcttcgccaatttcctaatggggcaagtttggacaagttatttaacttctcaggacctcagtttcctcatctataaagtagagatgacatgaaaagtgttgtcgaaagacaacaatgaaatgatacctgtaaaatgcttggaaaagcatgacacatagtaagtatttgataaatgtttgctggtttttataataatcataatcatacttgtagtttttattttattgaactctcaaggaggaaattgagagccaagttcatttcgagcaaagcttcaaagctctcttatct

SEQ ID NO: 5487 - DNA, 651 bp, Homo sapiens
tacggccgggttacgtgaaaggctgagtgctcgatgggaggagggtttgctgggtgagctggttcagactccttgaaaaatcatcgtcactctttcttcctcgcggacgtcctgcccatcgctctgagccggcgccccaagtagagccagagtagttcgtacccagccttttcacgtaactcggccgaggtggttcttctccgaattttttccgtcaggcccagattagcagattttggggtcagctgggagaggcgttaacttttcttcgcacactcttgctttgtgcgctcaaccacagtctgaattctcgcagaggcgttccttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgt

SEQ ID NO: 5488 - DNA, 512 bp, Homo sapiens
ggcggggtggaagagcagtgcaaacggcgcaccatcctgacagccatacactgggggccttgggtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcagacggcagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagggccgcactggctccaacaacttggagttcttg

SEQ ID NO: 5489 - DNA, 480 bp, Homo sapiens; identical to SEQ ID NO: 1177

SEQ ID NO: 5490 - DNA, 336 bp, Homo sapiens; identical to SEQ ID NO: 1178

SEQ ID NO: 5491 - DNA, 285 bp, Homo sapiens
gggttaatatttgtgaggaaaagtgaaacaagtgatctggttttagcccagatgatgaaagtggatgtggggggttttcacacacgtgagataattaccgcttgccccacaacactgggtgttggagaaagggagagatagtcataagtggaagaaaagcccagcctagtgagtgggaaagagagtgagagcctgtgccggctgctgacgagccccaggcggggcacaagtttctcgtggggagatggaggcagagccccgggtaggggacagagctgctggggc

SEQ ID NO: 5492 - DNA, 536 bp, Homo sapiens
aactgttgcaatagaaaaaaaatagaataagttatatttttggagtaacatcaatggttaggcatttttacaccgatcggtgtttgaaaatttgccatttcaggctaatatttttatatatttttgactttttaaaagttcatcagtgtttttgctactgttaagcttatgccgtttatactgtattttttatgtatcctttatattgacgggacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaa

SEQ ID NO: 5493 - DNA, 310 bp, Homo sapiens
  misc_feature 231: n = A,T,C or G
tatttttagcttttcattttgaatattttcaaccttacaaaaaagttgtgaaaatactacaaagacctgaaaagcgattttgctaagttgtgccagacacagaagaccacatattgtatagttgcatttatatgaaatatccagacaaagcaaatctgctgaatgcatgccccaaaagttcatgtgttggacttaatccccagtgcaacagtgttgggaggtggggcctantaagaggtgattgggtcatgagggcagaaccctcatgaatgaatgtttttttgttgttgttggtttaatttgagaagga

SEQ ID NO: 5494 - DNA, 743 bp, Homo sapiens
  misc_feature 616: n = A,T,C or G
tttgggaatgcaacaactttattgaaaggaaagtgcaatgaaatttgttgaaaccttaaaaggggaaacttagacaccccccctcaagcgcaggaccaagtgcagagtggactctttctggatgttgtagtcagacagggtgcgtccatcttccagctgtttcccagcaaagatcaacctctgctgatcaggagggatgccttccttatcttggatctttgccttgacattctcaatggtgtcactcggctccacttcgagagtgatggtcttaccagtcagggtcttcacgaagatctgcatcccacctctaagacggagcaccaggtgcagggtggactctttctggatgttgtagtcagacagggtgcgtccatcttccagctgtttcccagcaaagatcaacctctgctggtcaggagggatgccttccttgtcttggatctttgccttgacattctcaatggtgtcactcggctccacttcgagagtgatggtcttaccagtcagggtcttcacgaagatctgcatcccacctctaagacggagcaccaggtgcagggtggactctttctggatgttgtagtcagacagggtgcgtccatcttccagctgnttcccaagcaagatcaacctctgctgatcaggagggatgctttcctttgtcttggatctttgccttgacattctccatggtgtcacttcgctccaccctcgagagtgatggtcttaccagtcagggt

SEQ ID NO: 5495 - DNA, 524 bp, Homo sapiens
  misc_feature 469: n = A,T,C or G
gcccctagccccacagccaagacagtttgacataacaggccccggggccatggttgggtagaggcagggtggcctggcctcctgattagtggctgtggccgtggccaccatgactgtggccgtggcgtggcactgtgatcttggccactgtggtcttagggggtgccctccccgaggcctggcttatggtggtggccagggccctcgtcaccctcgtgcatcttctcgtgggaggcccaggttagcctcgccatcagcatgatgaactcctcgaagctcagctgcttgtctgcatttgtgtccaggtcctccatgatgtgttctatgaccttttcattcttattctccttcttgagaaaattttgcagatcttttcgcaccagctctttgaattccccctggttcagggtgtctgggtgccccagcttcacagagtattggtggaaggtgttgatgatggtctctatgntgcgttccagctgcgacattttgcaagtcatcgtcttgcactctgtcaaaccgag

SEQ ID NO: 5496 - DNA, 355 bp, Homo sapiens
acatgttttttttttttttttttttttttttccgatggagtctcgctctgctgcccagcctgaagtgcagtggtgtgatctcggctcactgcaacctccgccttccaggtttaggtgattctcttgcctcggcctcccgagtagctgggatggactacaggcacatgtcaccatgcccagctaattttttgtatttttagtagagacggggtttctgtgttagccaggacggtctggatctcctgatttcatgatccgcccgcctcggcctccctacctcttcctttacttaataagaatgcggtctaattttcaggtgccaagcccccaaactcctcttctagccttctgaatt

SEQ ID NO: 5497 - DNA, 423 bp, Homo sapiens; identical to SEQ ID NO: 1183

SEQ ID NO: 5498 - DNA, 321 bp, Homo sapiens
tttttttttttttttttttttttagaatatgaaccctaaacttgtgtatactataatattctgctaatattatttttacagtataagaataaagaagccatttttaaaatgaaattattaagccaatttgtccaaaaaaaatcttgattagatgtattatatattttccttattaaaaaaacctaataaaagaggtattaatatttttaagttatttaaaaattgtgaagtattttttttacaaaatactttaagctgttaactaagaccactaatgaaactcacagttaaactttttttctcttaattagaacttaaaga

SEQ ID NO: 5499 - DNA, 100 bp, Homo sapiens; identical to SEQ ID NO: 1185

SEQ ID NO: 5500 - DNA, 582 bp, Homo sapiens; identical to SEQ ID NO: 1186

SEQ ID NO: 5501 - DNA, 540 bp, Homo sapiens
ttttttttttttttttttttttttccggccttttattcatttattgagcaaaacacaagtaggatgatacaatgaggcactgacgcagtacaggaagcaatggtgcttttaatgaaacttctttcaaatctgtgaacatgctagctgtgaagtacatgcttttattctttccataggacatatttccaaataatgatcacagtattatggttaataagatgctggacagatgcgtagccaaagaatattacataacaacaaaatctcatcaatgatatatcaaatgcaaatttactaagacatcaagagaatatctgtttgtagttacatggctaaaaacaagacattattacagtaaccaagtccataaaactagaaaaaaagcactgtataacaaaaaggccttttagaagctattaaatgaacaaacattatagataaaccaattttatatctgaagcagcttatagcaccaacacgttggcaggaccagcagaggggtggggtctttggaccaaggcatctgggaacaggaagggc

SEQ ID NO: 5502 - DNA, 470 bp, Homo sapiens
actataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactgggcttcgggcaggagtgcacatcaaactgcccctgctaagcaaagatagccgcttcccaaagatcctggagaacctaagactccaaaagcgtggtactggaggagtggacactgctgcc

SEQ ID NO: 5503 - DNA, 450 bp, Homo sapiens; identical to SEQ ID NO: 1189

SEQ ID NO: 5504 - DNA, 444 bp, Homo sapiens
tttttttttttttttttttttttttatcggggctgcctgtgtgctcacaggctgtttatttatccaagagtaaggaggagagagacaggatgaagagaaaaaccagactccccacggtggcagggctgaggggaaaaacaaacagaaaatcccctcttctttctcttgctgctgaccccagggtactccagcttcagatgggacctctgggggtggcttaggggcctcgaggaggcccggcagctcagctgttggctggggtcaggatccgcacaggggcaggtcccagactcggaatggcttctgtgtacacaaaatatctctctgcaaaaggcactggtggaggggggcagcaggaaggccaccccatcacaggcagagtccactctgtcctgcgtctgggtcctgggccccaagaccaatccagtctccctcagggttggg

SEQ ID NO: 5505 - DNA, 580 bp, Homo sapiens
ttttttcttttttttttttttttttacgacggagactcgctctgttgcccagactgtgccgtggcacgatcttggctcactacaacctctgcctcccaggttcaagcaattatcctgcctcagcctcctgagtagctgggattacaggtacctcccaccatggctggctaatttttgtatttttaatagagacaaggttttgccatgttggccaggctggtctcaaactcctgaccttcagcagttcacttgcctcggcccctcaaagtgctgggattacaggcgtgagccaccgtgcccagcccctatatccaattttgatatctactttctcctacgctgggttttatatccttgaggggctgcctcagatgtaattgaatcagtcaaacattctcagaaatttgggccacagaatccattcttcaagtgcaaaatttatttgaaatgccaagtcaaaagagcttctctaatcaaagaggggatggggtagcccaattcctatagctccattctattttcttcagagctttggggttccaaagagcatgatgtaaaagcaattggtctaatctactct

SEQ ID NO: 5506 - DNA, 384 bp, Homo sapiens; identical to SEQ ID NO: 1192

SEQ ID NO: 5507 - DNA, 516 bp, Homo sapiens
gcacttaagcgggccatgccatgcaaccttgggcgctgccaaccgtgggcgacctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagcttta

SEQ ID NO: 5508 - DNA, 333 bp, Homo sapiens
cgcctacccccaacagaaagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtg

SEQ ID NO: 5509 - DNA, 399 bp, Homo sapiens
ttttttttttttttttttttttttttggatttttaatagagatggagtttcaccatgttggccaggctggtcccaaacccctgacctcaggtaatctgcccaccttggcctcccaaagtgctgggattacaggtgtgagccaccgtgcccagccaggtctgccttctgatggggcacagactagtgcaacatctagtggacagagtgtaggggtgtcctgggtgaccacaccctgcctctcatctctggttatgcccagagacagcccatgtgctgttagacacccatagcactgcagccactctcttcctaaatcctcccagctttgcatgcctggaaatgctgcaacaccaaggcagaagcaaagcctttcttttgactctgccacatggcatgggt

SEQ ID NO: 5510 - DNA, 371 bp, Homo sapiens
tttcaagatgctttctgtatttatttaaaaaaaaaaaattccagaatgggtaagagaacaatcatcaaggatgtaggtgccagacacagggcagaaggtagctagaaaagtatgccttagggaagttaaaggtctagcctcattcctaccttgttttaatagctgtacctaatataaatagctaagtttcccattgttctagattcctctgccccatctacaaacatggcacagccagcttgactcgcaaggcctcagttgaaggaccccatgtacatacaggccagtacagcagtactaggctaactagaaggatctcatccccatatgtggtctcatttcaagtctatggatgactaccttcattgctg

SEQ ID NO: 5511 - DNA, 356 bp, Homo sapiens
ttttttttttttttttttttttttttaggagagacagggtttcactgtgttagccaggattgtctcaatctcctgacctcgtgatctgcctgcctaggcctcccaaagtgctgggattacaggtgtgagccaccacttttaatacatgatttcaaccaaataaaacttttaccctaacgttttcatctaccagaagatttcacggagtttttcatattcactattaacaaaacaccaaacatcctaggtatgcaggacactgtgacacaagttacctggaaaagtgcctccaggctgaggtttgcttgtcctgtagcattaagggccttgatggcagatgttctgtaaggacaaag

SEQ ID NO: 5512 - DNA, 430 bp, Homo sapiens; identical to SEQ ID NO: 1197

SEQ ID NO: 5513 - DNA, 519 bp, Homo sapiens
agacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaacgtacatcttgtataacttaaggagcgaagaaaatgtagacgcgaaagtgaaaagtgaggcagctagttcttcctattccattctcgaccaacctgccctttcttaatatgactagtggtcttgatgctagagtcaacttactctgttgctg

SEQ ID NO: 5514 - DNA, 542 bp, Homo sapiens
  misc_feature 87: n = A,T,C or G
agattctcattacaacagtgccacccaatcttcgaaaactggatccagaactccatttggatatcaaagtattgcagagtgccttancagccatccgacatgcccgctggttcgaggaaaatgcttctcagtccacagctaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttca

SEQ ID NO: 5515 - DNA, 596 bp, Homo sapiens
tgcccatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtgtccctgccccgtggagcctttccccccagagggccccgcccagtgcagtcggtggtacctgagatggaggagtcgggagcacagctgctgctggaaatgctgac

SEQ ID NO: 5516 - DNA, 608 bp, Homo sapiens
atcgaagaggcggcgcgatctgtgtcgggcattaccagaagagtctccatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttct

SEQ ID NO: 5517 - DNA, 648 bp, Homo sapiens
gcgtgtgtgcgcctaatctcaggtggtccacccgagaccccttgagcatcaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacgaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgc

SEQ ID NO: 5518 - DNA, 441 bp, Homo sapiens
tagcctgggtcaggagtttgagaccagcccggccaaaatggcgaaaccccgtctctaaaaacacaaaaattagccgggtgtggtggtgcacacctgtaatcccagccactcgggaggctgaggcaagagaactgccgggaacccaggaggcagagctttgcagcgagccaagatcatgccactgcacttcagcctgggcaacagagcgagactctgtctcaaaaaataataaaacaaaacacagaatataagttccataaggaaggagatgtttttctgtcatatgcacctcctgtagccaggactgtatttcagtgagtatctgtagggtggacagatgggtggatgtgggtgactgattctagaagagtaataaatgtgtcagaccagctgagaaagtctttttttttttggaaacaaaatttaactttttttccccag

SEQ ID NO: 5519 - DNA, 67 bp, Homo sapiens; identical to SEQ ID NO: 1202

SEQ ID NO: 5520 - DNA, 546 bp, Homo sapiens; identical to SEQ ID NO: 1204

SEQ ID NO: 5521 - DNA, 553 bp, Homo sapiens
agaaggacactgttgtggtccaggatttgggcaacatcttcactcgcctgccactcaagcggatgtggcatcaggcactgctgcgctcaggggataaagagcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaa

SEQ ID NO: 5522 - DNA, 426 bp, Homo sapiens
gtttggtcgttcgttgggcggtgctgatttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggt

SEQ ID NO: 5523 - DNA, 625 bp, Homo sapiens
ttggaaaaaccacactaggcaaagaacttgcgtcaaaatcaggactgaaatacattaatgtgggtgatttagctcgagaagtctgatcatcggatatcatggagtctggcaagacggcttctcccaagagcatgccggaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagt

SEQ ID NO: 5524 - DNA, 621 bp, Homo sapiens; identical to SEQ ID NO: 1210

SEQ ID NO: 5525 - DNA, 525 bp, Homo sapiens
tacggccgggattctgaggtggcatattgtggcttcccctcattccatcaaacctttagacataagaacaattgactgacctggtgcctacccagtttgctggtttcctgcctataaggaaagttatgttgcagatcagtggtagacctgaaagtcacataatagaaaaaaaggaggataaggagaaaatgaattgctgttcccaagtaatcgagatttgtttcttcttgcagggaagatgattgggaaaatattgtgacctgataaaagtgttgatacatttaataagggtttgccaccatctgactaaatgataacatgcctttcagagtcttttctgaaaaatatcctgaaacagtttggcatactccttcagcaacactgacatcttcatgtgtttacgtagacatatcccgccactttgccgtactaattggcactaggagccaccaagtaacatggggagaaaaaaggggactacaaatggcagctttgaattggctatttacatcagttgtatttggg

SEQ ID NO: 5526 - DNA, 429 bp, Homo sapiens
gtaaatgaaagaggaattatgtggatgtgatggtgcctttaactgagatgcaaaagactgtgagaggaactcattttgagcagtctttgctaatcaatagataggtttgaagtagtttcagacattcaagtggcgatgctgaactggaagttgtatgtgtaattgtagaagtgaaggtagaggccaggtgtgaaggtagagccctccactgggatcagaagcactgaaactagtgggaaagggagagagagatgaggaccaaccttttggagctcatttaatggtcaagaagatgaagtggatgctgcggtggactggagaaggcaagttgttaaggaaggcagtttgtgtggatattttaaatctgagtgccaaaagttttagatttaagcgtcaaaggtgatgcacctttgcttttttttttttaaa

SEQ ID NO: 5527 - DNA, 516 bp, Homo sapiens
tacggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaatccattgtctcagtgaaggaagaacctgtagaagatgacctcgttccggagctgggtatctcaaatctgctt

SEQ ID NO: 5528 - DNA, 463 bp, Homo sapiens
tacggccgggattcatatcgaattggaaaatcgcggataattctagtcttactatactacctaatatagcatcctactatacacttatgttaagtttcttgatagcatttatcacggccgagcgcagtggctcatgcctgtaatcctagcgctttgggaggccgagtgggtggatcacctgagttagggagttcaagaccagcctggccaacacggctaagccctgtctctgctggaaatacaaaaattaaccaggcatgttgagcgcctgtagttccagctactcggaaggctggggcggggggattgcttgaacccaggtggcagaggttgtagtgagccgagatcatgccactgcactccagcagtggaaacagagtgagactgtcttaaaaacaaacaaacaaaacaacaacaacagcaacaaaaagcatttattatataaatactgtcttatttattt

SEQ ID NO: 5529 - DNA, 123 bp, Homo sapiens
ttttgtcccttcccctgccccttagagtttgcagggctgtcagaacccgaggagggtgtgcgtcctcacgtcaaggggccactcgctgccagcggcttgaaggatactggtgatgcagctgcc

SEQ ID NO: 5530 - DNA, 461 bp, Homo sapiens; identical to SEQ ID NO: 1218

SEQ ID NO: 5531 - DNA, 538 bp, Homo sapiens
atatgatgacataagacttcactccaacttccagttcaaattcccatcagatctaggtatagtttgtttcttatctttgattttttgaggatatattgtataagatatagcctcctttagtgctaatttgaatatattttcacttgtttcatccaaaatagccttagtgagacttgttactttccacgaaaaacattttcatttttaatgtaccttttcagtgtggcttttccaatgtatttatctgttgaaattgtaaaggtgctttatgatctagcccaattcctatttgtgactttttagaaatttcaccccaaattagtattgtttttacacacctttgttcttagtgcacttcttattctattcaaagccttagacattctacttttgatattttaagttctgtatctatttccataatactactttgaaccatatcaaattgtcccgggtattaatattgtacaaatcgccgatacttgactatttttgacttactaaaatggcaatttcatgcagatcaacttattatatt

SEQ ID NO: 5532 - DNA, 539 bp, Homo sapiens; identical to SEQ ID NO: 1220

SEQ ID NO: 5533 - DNA, 103 bp, Homo sapiens
actttacaagcgaggactattatatttatataagaaaagctttagatactgggtgttttatgcaggtggcacatttagaacgaacaaggcattacttaagtgt

SEQ ID NO: 5534 - DNA, 510 bp, Homo sapiens
ggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggtcctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaagggtgttcaatcaacctaaagctaaagccaaggagctgggcatagagatctgtcttatgtacatagagattgagaaaggagaggctgttcaagaagagctcctgaaaggcttggacaataagaatcc

SEQ ID NO: 5535 - DNA, 542 bp, Homo sapiens; identical to SEQ ID NO: 1222

SEQ ID NO: 5536 - DNA, 547 bp, Homo sapiens; identical to SEQ ID NO: 1223

SEQ ID NO: 5537 - DNA, 587 bp, Homo sapiens
cccagctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccatgcgggtgatggacatgctgcactctatgggccccgacaccgtggtcatcaccagctccgacctgccctccccgcagggcagcaactacctgattgtgctggggggtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgag

SEQ ID NO: 5538 - DNA, 376 bp, Homo sapiens
agaatttctctctctcttttaatagttttattttgtctgtcctgtttgttcatttggatgttttaatttttaaaaaaaaaaaaaccttggcggattttaataatttggtaccataggaaggtttccctctacagtattggcctggccagtttataccaaaaaaaggcggggtttttatttttttgggaacctttacggttttgtttaactttgggccaaaatttttattggaataaagggctacctaaggtaaaaaagttcaaagtttataccttttcctttagggcctcagggggggttttagggtagggggtttaagggaaaaaaattttcaaccggggcctcatggccaatttgggggaaaaggagttggggc

SEQ ID NO: 5539 - DNA, 573 bp, Homo sapiens
ttgtaaaaaattccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagcctgacactattagaagcaatcttcactatatgaaagaaactacaagtgatgatcccgacactattagaagcaatcttccgcatattaaagaaattacaagtgatgatgtaagtgctgctaacactaacaacctgaagaagagcacgagagtcactacaaacaaattgaggaacacacagttagcaactgaaaatcctaatggtgatgctaat

SEQ ID NO: 5540 - DNA, 609 bp, Homo sapiens
gcggcgacagggtgttcccgaactagagtggggcatacataatcttgctgctatgcctcgaagctgtagtctgaatcaacctaagttttaaacagaaggtgaacctctgagaaaatcaagtatattttaaaagaagtgatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatgggatctggtccaaacaatcatggaatttccaaggggattcaaacttcaacagaatgtggcaaccggaatggggaatgcatcagcagcccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcag

SEQ ID NO: 5541 - DNA, 636 bp, Homo sapiens
acgcagttagtcggctgcatggcgccggtgaggcggtccgcgaagtggcggcctggtggtattgaggcgcgtggtgaaggggtttccactgtcgggtacaggaataagaatgtgagacagaagactggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaaga

SEQ ID NO: 5542 - DNA, 650 bp, Homo sapiens; identical to SEQ ID NO: 1226
  misc_feature 582: n = A,T,C or G

SEQ ID NO: 5543 - DNA, 616 bp, Homo sapiens
ttagttaccagcatgccattgaagaatctgtcgttctcatttatgatcccataaaaactgcccaaggatctctcactaaaggcatacagactgactcctaaactgatggaagtttgtaaagaaaaggatttttcccctgaggcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaagagttcactgcccaaaacttaggcaagctcttcatggc

SEQ ID NO: 5544 - DNA, 476 bp, Homo sapiens
ggaatcttcccacgcacctacatcgaggtaccgcagcctcttttcttcctaaggaaaagcctgacagtgcccaaagcaccatttatttaccaaatgcttatgttttgtttcctccttttcctcttgtttccctgctttcttctcttcccttgttctcttttacctctttccctttctcagctccttcctcctgctgagaaggcacagcccaaaaagttgacaccagtgcaggttttggaatatggagaagctattgctaagtttaactttaatggtgatacacaagtagaaatgtccttcagaaaggtaagctgcacttctcatgccttgctttggggctctcttggatggcgcagctatgtggggaagcgtggtgttgctatcacaccccagtctgggggtgctgtctgtacccttaagagaagtatgccaatcaataattgcattaagggctgggcacggtggctcatgcctgt

SEQ ID NO: 5545 - DNA, 543 bp, Homo sapiens
aaaagacatcttgcttggcactaaacaagaaccaaaacagctaggatttatgtttgaccacattaataataaaaacttttgaacaaagaaaggcatcataagtataatcagataataagtaacagcctggaggaaaatattttcactatacaaaggtgatgggatactatatattgcatacaaagagattctggctgggcgcggtggctcacacctgtaatcccagcactttgggaggctgaggtgggctaatcacccgaggtcaaattcgagaccagcctggccaacatagtgaaaccctgtctctactaaaaatacaaaaattagccaggtgtggtggtacatgcctgtagtcccagctacttgcggggctgaggcatgagaatcatttgaactcgggaagcagagattgcagtgagccaagattgcaccactgcactccagcctgggcaacagagcgagactctgtccccccagaaaaaaaggccggcatgatggctcacacctgtaatcccagcactttgggaagctgaagcgggtgga

SEQ ID NO: 5546 - DNA, 549 bp, Homo sapiens
ttaagacacagaatctaggaaatgtttagagaaaatggctatgaaagggaagagagaaaaacgtgtatctgaaagaggaacaggcatggctttttagttaaagaaaaaggtatatagacttgagcatgtgtaaatgctgctggtgaaaagccagtagagaaggagagtgaataaacaaacggagagaaaagaggcattagacagagcacagcccccagagggaatcaggacccagagctcagagcagaagcaccccactttcctgtaacaggaggaaagaagtgatggatgggggtaggtgctgctaggtttgagggcctggtagaaaatgagagtttctgcatggtgtttctattttctctgtgcgatacgaaacctcatcctatgccagagtgagggcagaggctgaggaccttgaaagaggtctcatacaggcactgctgttaacgggagagaatactgatgaaagcagcagaaatgaatgccgggtggcactgaggatgctgtgggcgtgaccatacatttctggaggcccccatttgtttggct

SEQ ID NO: 5547 - DNA, 533 bp, Homo sapiens
acatagattatccaggctgagatggaaaacaagccctttattgaattttcaacacagactccctgcttctcatctccttaataaaatttcattaaaatccccttgaactcccatgttcaaatctccatttgttgacagacaaagccaacaatactctaaactgaggcctgcaagtcatttcatttgtatttttgtccagaaatttcccataggaagacttcacctcctacaactccgaagaaaacccttactgtccaagaccgtcaccagcaaccatccgcagtcattcaagtggaagctttcacagcttttgtacattctctgtgtcaatatacaactgagttacagactgtcccctggctccctgacccttacaaacactaaaagttttgtttgactcaacttcaagctgctcatctgttagtaagtgatgttcactccagaacacattcatgatgagaactttctaaaagaccagcactgctcttcccctccctatatcataataatcatgataacctgaaacatgttac

SEQ ID NO: 5548 - DNA, 611 bp, Homo sapiens; identical to SEQ ID NO: 2681

SEQ ID NO: 5549 - DNA, 510 bp, Homo sapiens; identical to SEQ ID NO: 1232

SEQ ID NO: 5550 - DNA, 483 bp, Homo sapiens
tggtgaggggctgctggtggcggcgcattctcggtaggcggtatgagtttggctgggggccggacaccccggaagaccgctgcgaaccggctttctgggcttttggaggcagaggaggaatatgagttctaccagacgacttatgggggtttcacagaggaatccggagatgatgagtatcgagggggccagtcagacacagaggacgaagtggactctgactttgacattgatgaaggggatgaaccatccagggatggagaagcctaggagccacgaacgaagcgccgagtagtcaccatggcctatatggaacctctcaagagcttaatgcctcgaaaggtcaacaccccggctggtagctctcagaaggcgcgagaagagaaggcactactgccattataactacgagatgacggctctgacagtcggaagtctatgcgtcagtctacagctgagcatacacgaccaacgttccttcgg

SEQ ID NO: 5551 - DNA, 528 bp, Homo sapiens; identical to SEQ ID NO: 1233

SEQ ID NO: 5552 - DNA, 601 bp, Homo sapiens; identical to SEQ ID NO: 1236

SEQ ID NO: 5553 - DNA, 505 bp, Homo sapiens
  misc_feature 370: n = A,T,C or G
tacggccgggtgtgttttattctgattttgggggaggttatatgggtttaatagtttttttaatttatttagggggaatgatggttgtctttggatatactacagcgatggctattgaggagtatcctgaggcatgggggtcaggggttgaggtcttggtgagtgttttagtggggttagcgatggaggtaggattggtgctgtgggtgaaagagtatgatggggtggtggttgtggtaaactttaatagtgtaggaagctgaataatttatgaaggagaggggtcagggttgattcgggaggatcctattggtgcgggggctttgtatgactatgggcgttgattagtagtagttactggttgaacatntgtttgttggtgtatatattgtaattgagattgctcgggggaataggttatgtgattaggagtagggttaggatgagtgggaagaagaaagagaggaagtaaagtttaattatgcctttttgggttgaggtgatg

SEQ ID NO: 5554 - DNA, 577 bp, Homo sapiens
tacggccgggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaac

SEQ ID NO: 5555 - DNA, 530 bp, Homo sapiens
gtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacaggtcgttggattaattatgg

SEQ ID NO: 5556 - DNA, 507 bp, Homo sapiens
ataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttaggtaaacacatataaatgtgtgcatataacctcttaaaagagggaagctaggccgggtgcggtggctcacatctgtaatcccaacactttgggaagccagacgggtgtatcacctgaggtcaggagttcaagaccagcctggccaacatgttgaaagcctgtctttacaaaatacaaaaattagct

SEQ ID NO: 5557 - DNA, 520 bp, Homo sapiens
tctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaatttt

SEQ ID NO: 5558 - DNA, 519 bp, Homo sapiens; identical to SEQ ID NO: 1237

SEQ ID NO: 5559 - DNA, 580 bp, Homo sapiens
cggccgggtatttagcatgagaaaaaaaatccaactctgcttttggccttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgag

SEQ ID NO: 5560 - DNA, 244 bp, Homo sapiens; identical to SEQ ID NO: 1238

SEQ ID NO: 5561 - DNA, 300 bp, Homo sapiens
ttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccct

SEQ ID NO: 5562 - DNA, 399 bp, Homo sapiens
  misc_feature 399: n = A,T,C or G
gactttggaacacatattagtggtaggattatttactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattan

SEQ ID NO: 5563 - DNA, 236 bp, Homo sapiens
tttttttttttttttttttgggtaaagaaacctttaatgaggattcaaggttaataaggaagacgcagagggccagcactcagccccaacctcctcacgtgtacatggctccgtggaggttctccagtcggtgttgctgctgctgttttcgagcctgaaggaaagaaagcatgctgggcaggggccaaaactgaaggcctatgggtgaggggatgggcagctattatggggctggc

SEQ ID NO: 5564 - DNA, 616 bp, Homo sapiens
ttttttttttttttttttttttttccgaaaaatatttcatttctccattttctttttcaggggtcttttgaagaatccaatcttccacagtgctaaaatgagcagcattaacagcaacaatccggcaaaagcactcagcaggatgacccataatggcactctgcccggtagcccatctttggatatttgaatagcaagctctcttttttgattgctgctacttaaaaccagagatgcattttcactccgaagttctccccttatagtaagatttaagctggaaaaatatgattttataaaagttggtttccacaagataagcgaaacattgacttggctgatgtcagaagaagtgagattacatgtgatggtagcaaatttacatgtattgcagtccagaattgtgcctcgtttgagatggtcagttgatgtagtcattttctttccagagttgatactgaaaggatcctcaagatatggggtctgcagtttgcattctcagaagatgacaatccagttgggtacagcacagggtaaccatttgatgtcatattggggaatgaaattgacagcttaagctctggcattggaaaagatccactttttctaatcaagt

SEQ ID NO: 5565 - DNA, 107 bp, Homo sapiens; identical to SEQ ID NO: 1241

SEQ ID NO: 5566 - DNA, 493 bp, Homo sapiens; identical to SEQ ID NO: 1243

SEQ ID NO: 5567 - DNA, 501 bp, Homo sapiens
tatggaccagtaccgcaaataacaggaattaactgtgtttgcaaaggtgtgggcagctagtagggaaacctcaaaggatagctagcataatatccacatgccagtgattgcggggagctttttccacctgtgggtctgaagggaaagggctgttagcagatgggagcatgtaactctgtgatgctgcagtgtagacgccgggaaatgcccctacccacctctctgtccattggccagtgtccccgatgggccgaaccaccctgctgacttttgaccttcacgcaggtccttcccggagctgggaattatccctttaccctcacctttgcccatcttgatgcccagaaatcttgcataggaggcaaatgctccccttgcaagcaatgtcttgccctggggtttgcagcctgccaccctcaccttgctgtcaccgccccagtttgtgacctcagctcacacaatgtccccaaacagcatttgcacaattccccccattgcctc

SEQ ID NO: 5568 - DNA, 578 bp, Homo sapiens; identical to SEQ ID NO: 1245

SEQ ID NO: 5569 - DNA, 114 bp, Homo sapiens
aaaagattacagtgatgctctcacaaaatcttgccgccttccctcaaacagagagttccaggcaggatgaatctgtgctctgatccctgaggcatttaatatgttcttattatt

SEQ ID NO: 5570 - DNA, 83 bp, Homo sapiens; identical to SEQ ID NO: 1247

SEQ ID NO: 5571 - DNA, 472 bp, Homo sapiens; identical to SEQ ID NO: 1248

SEQ ID NO: 5572 - DNA, 633 bp, Homo sapiens
tttttttttttttttttttttttgagaagagattttagttattcagtgttttcagagtttcaacaagggatacagatacaagcagcttcttacagagtttacaatctggggagagaacatgaaagacactgtttaacaggcaaataattccaggaataaatatacatgaatgtgtttttcaaaatacaggttcttatacaaatgtataactaaatactgattccatagtggggtggttgtaactgaaagggctttgagaaaaggctttgaataaaactagtcatccacctagccaaagatccttttcagcagcacaaaaggaatttgtaaggagaacagagattaactgtcagatatctttctaatctgtaaatttatccaaagtttgaaaataccatgaagaatcttaggaatgccagtaaccagggaatgggatatttgcatatcacaacatctacaggctaaatacactccgaatgcttctcaatgtggggaagtatgagaagttaataattctcctagtgtctggcttcctttttctttgcctttccctctcatacgttcaatcacctgtgttacaggacacacataagtagttggaaggtgttaaacttgacagcaaagcaaaatcag

SEQ ID NO: 5573 - DNA, 407 bp, Homo sapiens
tgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcaccc

SEQ ID NO: 5574 - DNA, 598 bp, Homo sapiens
atctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccgggatccagttaattactttgctgaggttgaacagatagccttcgacccaagcaacatgccacctggcat

SEQ ID NO: 5575 - DNA, 568 bp, Homo sapiens; identical to SEQ ID NO: 1252

SEQ ID NO: 5576 - DNA, 604 bp, Homo sapiens; identical to SEQ ID NO: 1253

SEQ ID NO: 5577 - DNA, 591 bp, Homo sapiens
tttttttttttttttttttttttttataaccttagtttaggtaaatttaatgactgtaaaagctgttcacatagcagctttaaagagacacgttttccactgacataaagttgcttcgccccttgcagcttatctccaccttcatgacctgtttcctcagtggcaggcaatgtctccccttcctgttggggaggattgcccaagtctgctctgaggccatcttctcaggtcagcaatatgcagaagagtccctcagagtggtcctgcagagaacatgtcccctaagtgtctgagaactggctgaggtgatcttcaccaccacatagtccccaggctgggctctgaccctgagcccagggttattgacatcctccatctctgcatcagggaagatcaccttaaggtttccatcattcctaccacacaggtcagtggcagagcgtttactgagcccttccactagcaccaactgggtacagcccacagaggtctgattggcttttgttgcttcttctcggaagatagtgatgagttcctccaaacgccttaattttacctcttccgggacatcatccttcagcctatgatatg

SEQ ID NO: 5578 - DNA, 524 bp, Homo sapiens
actggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatgggggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcct

SEQ ID NO: 5579 - DNA, 554 bp, Homo sapiens; identical to SEQ ID NO: 1255

SEQ ID NO: 5580 - DNA, 645 bp, Homo sapiens; identical to SEQ ID NO: 2537

SEQ ID NO: 5581 - DNA, 630 bp, Homo sapiens
cattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaagcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagcc

SEQ ID NO: 5582 - DNA, 644 bp, Homo sapiens
acagctgcctgggtaaggcccaagatggctgtcttcgccttagtactcgtgtgaagttggcggggacggttcctgtcatcttcttgggcttatttggtgtgctgtcgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgataggagagaaagctgagaacttcggaaaaggctcatctgtcaccctggagaagggaaactgtacttttccctgtgaggaaacggctttgtattttctctgtaataaaatggggcttctttagaaaaaaaaaaaa

SEQ ID NO: 5583 - DNA, 671 bp, Homo sapiens
cccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagctgctcttcagtaaatcctcggttacctcagcagctgcagtaagtgcattggcaggagttcaggaccagctcattgaaaagagggagccaggaagtgggacggaaagtgacacttctccagacttccacgatcaggaaaatgagcccagccaggaggaccttgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcg

SEQ ID NO: 5584 - DNA, 559 bp, Homo sapiens
ggactggactcggcttgggcgtgagatggcggcggcaacggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacatttttccaacgaggcaaaatctgcttcatccctcggtaccggttccagggcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaaca

SEQ ID NO: 5585 - DNA, 398 bp, Homo sapiens
tacggccgggaagtgggtggggggagttgaagggaggagaaaaagaatagaaatgtatttattactactgaactgaatacttaaaaacggtaaaaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccgggcgtggtagcgggcgcctgtagtcccagctactcggggaggctgaggcagaagaatctcttgaacccaggaggcggaggctgcagtgagccaagattgcaccactgcactccagcctgggcgacggagcaagactctgtctcaaaaaaaaaaaccaac

SEQ ID NO: 5586 - DNA, 492 bp, Homo sapiens
tacggccgggatcagagctttggcagtagaagatgatcaagttgcacctgctccattgaaagtcgttgaaacttcaagtagtgttagggaaagaaaaaagaaggaaaagaaacaaaagcccgtgcttgaagagcaggtcatcaaagaaagtgacgcatcaaagattcctggcaaaaaaagtagaacctgtcccagttactaaacagcccacccctccctctgaagcagctgcctcgaagaagaaaccagggcagaagaagtctaagaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtag

SEQ ID NO: 5587 - DNA, 323 bp, Homo sapiens
tacggccgggaggagctccttgagcccagagttcaataccagcttggacaacataaggagaccctatctctacaaaaattaaaacattagccaggtatgatggtgcacacctatatagtccccaccattgaagaggttgtggtaggaagaccgcttgaacccaggagttccagcctgcagtgagctatgatcatgccactgcactgcagcctgggtgacagagtaagaccctgtctcaaaaaataaaaatagaagtaatgacccaggtgcgagatggcaataatttgaatatgatgacgttagaggtggaaagacatggatgg

SEQ ID NO: 5588 - DNA, 435 bp, Homo sapiens
caggagttcaagaccagccttgcccacatggtgaaacctcatctctgctaaaaatgtaaaaattagccgggcatgactgtgggcatttgtaatctcaggtacttgggaggctgaggcaggagagttgcttgaacctgggaggcagaggttgcagtgagctttgtgccaccacactccagtctgggtgacagagtgagactccatctcaaaaaaaaaaaaaaaaaaaacccttaaattgggccctaaaaatgcaagggaaaaggggccagggcttcccccttttacccccaccttttgaaaacccaaattggggggatccgggaaaaccaagaatttaaaacccccctgggaaaaatggaaaaattttttttttaaaaaaaaattctaaaaaatttcctggacttgggggggggcttttggggccccaattttttg

SEQ ID NO: 5589 - DNA, 523 bp, Homo sapiens
tgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattc

SEQ ID NO: 5590 - DNA, 607 bp, Homo sapiens
tggagaagcggtatctggctgcaggagccgtcactctgctaagcctgtatctgctgttcggctacggagcgtctctgctgtgcaatctcatcggatttgtgtaccccgcatatgcctcaatcaaagctatcgagagcccaagcaaggacgacgacactgtgtggctcacctactgggtggtgtacgccctgtttgggctggccgagttcttcagcgatctactcctgtcctggtcccctttctactacgtgggcaagtgcgccttcctgttgttctgcatggctcccaggccctggaacggggctctcatgctgtatcagcgcgtcgtgcgtccgctgttcctaaggcaccacggggccgtagacagaatcatgaacgacctcagcgggcgagccctggacgcggcggccggaataaccaggaacgtcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccagtccctcgggtccaggcaaggccctgggggtc

SEQ ID NO: 5591 - DNA, 629 bp, Homo sapiens
tacggccgggcgtgggctctgctgccttgtaattcggccttactcacatttttagaatttcaaatctagatccctttatgcaagatatttctttcaaatatcttgcataaagttttcccccacagtattatacacaaatatataggacaaggatcctactatgtatattctaaccaacaaccgtgctgggcacatgattgatgataattgcccagtacatgtaatgaattgaattttctcagtaacaatttagtacacaattgacttagtatatggatcactagggatggatgaatacaaacaaattctgcactcaattttttcagatcactgaaaatcccagagcctctagagctctgttgaagtctactttataaaaagacatgaatatttacttactatacatttatacagcgtttattaagtagctattgattgttcatagttgccttctcagcaaccttagatcctcatagaaaatgcataattcttaaaggcatctaacatctccatttttttcaagttaataagaatggagtgaatacacagtagcatggggtacccttggcatgatgccgcgggcgaatgcagaatgcatcacgggatgactaatcccatttctttatcct

SEQ ID NO: 5592 - DNA, 602 bp, Homo sapiens
gatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagc

SEQ ID NO: 5593 - DNA, 533 bp, Homo sapiens
gcggacttgggcggccacagagcctttatgaccgaagagggactgaaatgccatcctgttatcaagaaggagcataagaacagctagaggagagatgcaagattgaaatatcatggaatggactatggtttatcctctcttctggttcgtaaaacaccatcaggttgtaattgttcagatcagaaattcccaagcttttaataaagccttcagggagcctcatccaggggcaaccgccctgtcattgggaataagtagagtgtgtgggaaacatgttgaccttggtaaaacctccccttaggaaagaaggcaagagaattgagtaagagaatgatgggccaaaaggagaaaatagagaaagaggctgcatgctacagagaacaagagcaaaattcagaagcctggcacagttgggcttgaaaccatctgtgtaaaggggactaataatgctgacctcactgcatcacaaatgacagagtttaaaatgatggtgtttttaagggacctagcacgtattaagaatttaatacaca

SEQ ID NO: 5594 - DNA, 468 bp, Homo sapiens
aggatgcgccaactacacacacagaggaatacagtggggatgagaaaacgtggatgtggaggcacaacttccggactttgagtgactataataaggggattgcatgggctcttgaaattggggctgacctcccatctaatcatggcattgatcgatggcttggggagcccatcaaaccagccattctccccactaacattttcctgaccaataagaatggatttgctgtactttctaaaatgcaccaacagctcaccttccgactcctcaagatggaggtgcagttcatcatgacaagcaccaaccaccactcacacaaggagttctgctcctacctccaatacctggaatacttaagccagaaccgtcctccacctaatgcctatgaactctttgccaagggctatgaacactatctgcaggccccgcttcaaccactgatggacaatatggaatctcacacatatg

SEQ ID NO: 5595 - DNA, 540 bp, Homo sapiens
ccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctg

SEQ ID NO: 5596 - DNA, 689 bp, Homo sapiens
agtgtttgttttacaataacaattgtatcttctagtgtttgcccctcaagtgaagttctccttagaagagaagatcttttgggaccagttccccccattttcttatatgttcactaatcagctggggttaacatttaattattcctcatattcacaaccacttaaacatttaatagagtttttaaaaatccaaacaatgtgtatcttgtataattttattttcatttaaaattctattaccaaaaaagccaggttagccatttgcttataataaatcatgccttcttttaggaatttttagagtcagtttaatgggactcctgagttgacagctgtacagtctgaattgccttagactctgaaaatgcttcagatttaaaatactaccaaccaacatggagtactgatcttcccacttgttgccaaagaggctagttaggaaaactagggacaggctgttctcttgcaattcaaaactgaacacaaactgaaattgagagaaagtcatattaaatcctcatgtctgccatgtttgcagaggtcagctatacaaatatgaatgttaatttgaacttcaagaaaaggacactgctaaaatataatacatcttgaaaatgaagatgactctctacttgttttaatcagaacctcactgatatgtctcagggattaatttcatatatcatatc

SEQ ID NO: 5597 - DNA, 611 bp, Homo sapiens; identical to SEQ ID NO: 1265

SEQ ID NO: 5598 - DNA, 490 bp, Homo sapiens
aaggaggtgattgccaagacaaaaacacaaaaagacacattctgcttattaaggaaacaatgagaaaggaaagcaaagctccccagaggccatctccattttatgtgtgagggtcccagataagggaaaggacttgactgatgtcctccaaacatcacagcatttcttcctccttatctggggcccattccactctgcacatccctcctggctgcttgcccacattactaattagtttcctcctgaaatatgccaaagaataaatagtgtaggctagttaaaaatgctcattctctccataaattttagtttcctctgttttttcttcccaataatactattttgttattgtctgcagtgtttgatgaatacaaaaggatatcacagaaggatattgaacagagtattaaatctgaaacatctggtagctttgaagatgctctgctggctatagtaaagtgcatgaggaacaaatctgcatattttgctg

SEQ ID NO: 5599 - DNA, 576 bp, Homo sapiens
caggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgcgagtcccgtctggtttccatcccaccactccaaggactgagactgacctcctctggtgacactggcccagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctgga

SEQ ID NO: 5600 - DNA, 495 bp, Homo sapiens
gagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcg

SEQ ID NO: 5601 - DNA, 574 bp, Homo sapiens
acaaacacctttcccaccaaaaaccccccaattttccgtttgccaaagatgattctagtagcatgaaatcaatatgttagatgtatatgtgtctttatgtaaaatgttaatttctttagagcactcacctaatattagtcagttaaacatatttgtataagaatgcctgtgttttatctttgccaaaaaatatctctttcaaaacaaacatagtgagtaacctatgtgatcactggccagtgattttgagttggaagaaagtgtgtgtgtgtgtgtgtttgtgtgtgtgtctgattgtgcagaaagagggtgtaaggtaggggcagagaattaatactagtataacttcccaaccaggaggaaatactgcatttcaaatttccagtgcattcatcagatctaattgaattactgccaccttactcaatatcagaatatttagagagtttaactacctctggtgcttttctcttccattgatgaagtaatctcagatctgaatttaactgacattcctgggcaaagaatgtttgataagggccgggtgtggtggctcacgcctgtaatcccagca

SEQ ID NO: 5602 - DNA, 607 bp, Homo sapiens
ctcaggcccttcttggttccgtgggtacaaaattgagctccacgcccaatggagagaatgagctatgcgcgcctccggggcgggccacgcggggccaggctgccccagggtgcccgaggcctcgcctcgtctcgccgcgaggactggaatctcgcagcaaggaccctcctcgcactggaggtatcgtcgagtccagcccctaagcgacagatggccggggtgccaccccacccttgagctgacgccaagtctggccggggaaaggtcctcaaggggctggaggatgctgccgccgccctcctgtcgagcctggcaatgggccagtcccagcgcctgccgcggtctccaaccttggcagataccgtgcagtgccgagttctgccgttatggggtccctggaggtcttcctgggaagaggattttggaagagatgataaggaaaagtgcacagcacagtttggccagctagcctactcctctccacccttaactttcctctgtgttttcagctggctcagctgaactaaaatgtggggtgagggacagctggtaggtctcatttgcccagatgggtgattttcacctcttagaaaccttcctaaacagc

SEQ ID NO: 5603 - DNA, 554 bp, Homo sapiens; identical to SEQ ID NO: 1273

SEQ ID NO: 5604 - DNA, 471 bp, Homo sapiens
tcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacgatgatcagtagaattgaatatgtgcatacaaagaattctatacacagagacattaaaccagataacttcctaatgggta

SEQ ID NO: 5605 - DNA, 682 bp, Homo sapiens
  misc_feature 613: n = A,T,C or G
gccgggcatgcagtctctcttggcttctttgagactgaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggngaagcgtctgaagggagcctttaggcagtgatgacgtccatcaagcagttgagcagtgaggagctggag

SEQ ID NO: 5606 - DNA, 628 bp, Homo sapiens
tacggccgggtagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacgtcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccatcccaaaatgtcccttgctc

SEQ ID NO: 5607 - DNA, 483 bp, Homo sapiens
tttctatctgcgtgttttaattatggaattttaatgttgattttcattctgttttccaatcccatatattttttccttctcattggcttattgtgtgggttatcatttcagtgacctggtttgacaagaggcaacacaaatttctttgagaattcaaatgtccatttaaaaattagcatcaggggctgggcacagtggctcacacctgtaatcctggcactttgggaggctgaggcagcgggtggattgcttgagttcaggagttcgagaccagcctgggcaacatggcaaaaccccgtcactataaataatataaaaattagctgggcatggtggcacacacctctagtcccagctgcttaggaggctgaggccagagggatcagttgaacctgggatgctgaggctgcagtgagccacgatcacgccactgcactctggcctgggtgacaaaggaagtccctgtctcaaaaaaaaaaaaaa

SEQ ID NO: 5608 - DNA, 610 bp, Homo sapiens
tacggccgggtgtggtggctcatgcctgcaatcccagcgctttgggaggccgagtcaggtggatcacttgaggccaggagttggagatcagcctggcaatagagcaaaaccccatctctactaaaaatacaaaaactggctgggcgtggtggcatgcacctgtaatcccagccacctgggtggctggggcacgagaatcgtttgaactcaggtggcggaggaacctagaaaacagagaggcagatggaacctagaaagcaaagagaaaacagcagcaggtaaagttgaagaggtaggcaggaacagagaaaatgcagccatgcatatcaggaaactcgccaaccagtatataaggacaaatattgactgcaggactagatattatttaaccccttattctgaactacctaaaccagaatataatccctgtgcagatggcgaccacattttcagtagattctcaaacaacttccacgcaacatctagcacgtgacaaattctgtacacacacacacataaatatactatttcctcaaattcaaacttttctaaaaacatccaaactacctaccttagttgggattaaacatatatttagtaacattgaatc

SEQ ID NO: 5609 - DNA, 609 bp, Homo sapiens
cctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgcgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatggaagagaccatgccgtggtcgtgggagtgta

SEQ ID NO: 5610 - DNA, 623 bp, Homo sapiens
tggcagatagcacattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactccgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcggttttttttcatgtattcattctgaatagttgaaatgtatatttgtacagtcttttagacctattcaagtgatgctcatgatcctgttac

SEQ ID NO: 5611 - DNA, 640 bp, Homo sapiens
attgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaaaaaaaaaaaaaaaaaaaaa

SEQ ID NO: 5612 - DNA, 506 bp, Homo sapiens; identical to SEQ ID NO: 1276

SEQ ID NO: 5613 - DNA, 175 bp, Homo sapiens; identical to SEQ ID NO: 1277

SEQ ID NO: 5614 - DNA, 564 bp, Homo sapiens
actgcatggccaggcaggcactatttaccaactaacacagaggagatcggtactgtgatcctgagtgcagctgtgcgggtggcctcaggggagcccccaccacaaagcacacttgaatagtgtgccacatcagccatgcgtggtggctcatgcccgtaatcccagcactctggaaggcggaggcgggcagatcccttgaggtcagaagttcaagaccagcctggccaacacggcaaaaccccatctccactaaaaatacaaaaattagccaggcgtggtggcacacgtttacctgtgtaacaaacctgcacatcctgcacatggaccctggaacttaaaataaaagttgaaggggaaaaaaaagagaatatttcagaagcagagtgcctgggcattgctcaatcagaacagatgctgagccaggtgcagtggcttacatctgtaatcccagcagtttgggagaccaaggcgggtggatcacttgaggtcacgagtctgagaccagcctggccaacatggctaaaccccgtctctactaaaaaatacaaaaagtagccggatgtg

SEQ ID NO: 5615 - DNA, 485 bp, Homo sapiens
gagtttgagaccagcctgggcaacctggcaaaactgtctctacaaaaaaatacaaaaattagccaggcattggtggcgcatgcctgtaatcccagctgctcgggaggctgaggcaggagaatcgcttgaacctgggaggaggaggtgggagtgagctgagatcgtgccattgcactccagcctgggcaacaagagccaaactgtctcaaaacaaaaataagtaaaccctgataaagtgtttttttccatcaggcagtcatactttgatacaaattggtttaatgaggcccagccttcttgccagagataccaaaaccactgtgggaaatgttttgactggataaaacactcttcagtgaggtgctatagtgaagatttctacagagagcaatgggaatcagcacctaggggtcaaggaagaagcacttggctgggcacggtggctcatgcctataatcccagcactctgggagcccaaggcagga

SEQ ID NO: 5616 - DNA, 288 bp, Homo sapiens
ggcgtgttctgtgcaggtgccgacctgaaggagcgggaacagatgagtgaagcagaggtgggggtgtttgtccagcgactcccgggcctgatgaatgacctcgttctgtgataagaccgatgactcacccagggggatggaggaggatgacccagggcagttctctcagagagggagttctggctcttcagcttttgtgtccccccccacgctgagggttcaagcctggccattcccaagcagttaagtttccccaagcctgctttcaagttttgacaattgctgtta

SEQ ID NO: 5617 - DNA, 417 bp, Homo sapiens
aggggggtgagattgtctccggaggcagacaacaggccagtggaacccagtcagaataagggagccttttgaggtgggtagaattgtttttggtcaaaaaagaggtgagatgatcaattagagtgattttgttgtgaaacttataaaatgcctctgacatcaagtctgggaacagatctttgtgtattaaccatagagagtgtgtttgaatcattgtataatgtctccggggcacttttatttaatatgcttatttatttatttacttatttgaattttagaggtgagacttgctatgttgcccaggctggacttgaactcctggacataagtgatcctcctgcgtagctggggagacaggcgtgagcagcttcacctggggcatgtttggttttttaaaaattatttacttggagg

SEQ ID NO: 5618 - DNA, 253 bp, Homo sapiens
cttttcaggaaaatgggaaaaccgtggctcccccaaaatgtatctggggttccctgaaatttgaaagactgtcggtctctctacttgttcaagccccttggcccttccttcagttctgcttttgccacatgtgtctaaaggggaatgggcaggcttttgagattgttactcagcattaatgtaaagacttgacagagagatcctctttttgattgccattccaaaatgggaatatatctcattcttttaggtt

SEQ ID NO: 5619 - DNA, 752 bp, Homo sapiens
  misc_feature 517, 528, 559, 571, 580, 629, 675, 676, 684: n = A,T,C or G
aaacaaacaggtttattgataagcaggaatgccgtccagcatacagtgcaaactttcattgtcttgggatcaacacacacacacaagggaaccaaggccccacagagtctccaaattcatcgcttcccggctctgccctgtgatgccaaggaagcctgaggttctcccaggactgtccaccagggggcaggtgcgctccatcatgtcctcatgtgggtccaatgtgggcagaaacctggccagtcccagcagtctgactttttttttctttaagagacagggtctcactctgttgctcaggctggagtgtagtggcgcgatcatagctcgctgcagcctcaaactcctgggctccagtgatcctcccctcagcctcctgagtacaggtgcacgtcactgcagccagccagtctgacatcttgattccagggtggaaaacccttcttgtctccatggtaatggctgggctctcccaccctccaatagttcagctgccaagctcaagtccagtggaatntatcaacaatntatcaccctgcccctgctctgctagacaatntcatgccttctnctttatccncatgctcctgagactgagcctttccaggagcccctcaacctgcttcctnccagaaatccggcaaggctacactggttcccctctgcaggcccctnngccctggnaggggaggctgactctaaatggggagaaatcccagctcagtggcttcaaggggcagcattcaacttac

SEQ ID NO: 5620 - DNA, 780 bp, Homo sapiens
  misc_feature 594, 688, 748: n = A,T,C or G
agtccatccaccttcatatcctttattgggagacgaatatacaaaataaaactcattgctatataagcaaatactggtgatttggcgactgtagcagacacttgtgtatactgaactcagcgctgaagtggagaagatgctgggatccagacactggtctgtgcctcctcattagatctctttggtgctcactctcttggtcttttcagctgtttcctgatgcttttggagctcctggacatatctggtcatctcctcctctgtctgggtctgggcccccttctgattctttccgtcacaggtcatggctgtacagacccaatttccacaggcacagacacagcggttacagtccacctcggtctcagctccatctgcatacgtttcatcctccagggcacacttcttctcaggagggttgaaagatgggttgaggcacttgagaaactcttggaagctgagtttccaatcagcattttcatcagacagttcaatgagagcatcaacacagagtcccctaagcaacttgttgttctcctggtctggatacgttgtaatattgatggcagcttcattctgttccacaaacttcangaattcactggagtccaggcgagaatcaccattatcaaagttcttaaaatacttgtctaggattcactgtaggtgctgcctttagagaaccagncaatctggatgatctcagcttccagccactggatgatgcgacgtcgagctcatcacgctngactgatagcaaacacatgggctggcagagga

SEQ ID NO: 5621 - DNA, 473 bp, Homo sapiens
tttttttttttttttttttttttttacaattcctgtaagagaggctagtcaggagggacaccctcaagtttaaatccccacacttacttacttactgctcatccgtcactttcgctaagtgagattaataattcagtagctggtccagaacgcacagcttgggaacgcagaggcccaggcctcatgtaatttcccactcccgtaactgaacgtgctgacccatgttgatgtctgccttcatccaggtggcaaatcagacatgctacgctgcccccttcaaacgagttcctcgtgttaggggcaaaggtcacagccaaactctgccactgacagccagtgccttggcctggatcctctctgtggatgcaggcctacccctcctcagtccagcctcatctactagaccagcttggccattcacttttcggatgtctgtgagcacaggactgcagactgaactctcactcaagttc

SEQ ID NO: 5622 - DNA, 504 bp, Homo sapiens
tttttttttttttttttttttttttagagacataggctcttgctctgttgcccaggctggagtgcagtggcccagtcacagctcactgcagccttgagctcttgggcacaggagatcctcctgcctcagcttcctgagtagctgggactacaggcaggtgccaccacacttggctaacttttgtatttttggtagagacagggcctcagtgtgttgctcaggctggtctcaaactgggctcaagtgaagattccttttataaggctgaataatattccatgtgtttttatttatttatttcaaactaatgcagtttattataacaagaaggaaatcaagctttacagtaattatagtcactaagctgaaaaatcacctacaaaagtcatggcaataacttatttacagttaaaaaagagaatatcaagatcttgctctcatagtaaggtaaactagacatgtacacaatcttatgatgccaagaaactgaatatataaaaatag

SEQ ID NO: 5623 - DNA, 502 bp, Homo sapiens
ttttttttttttttttttttttcgaaacttaagtaaactttattttcaaaatgcttcaggtacaaaagaaaacaatggcaaagtctaacaataattaacaaaccagctcttgagcggcagagtgctccagggatgagaggggctggggatggaaaggtggttgggagacacaacatttttctagcttcagaaagtcagggagcccagatcacagcctgaacatcatggtattggttacggattctttacaaaggtgtttacctctctcatgaggtcttcttgtttggttacttcctcagaaaaatcatcattgacatccaacaccagcactggaatgttcatcagagcctcaaagtggagcctgtcactgtacacagacctctcaaagatctgtactggcttcctggcctgtaagagtttctcagggaagggctccagctgtactttcaggcggctcaaaaaggaaaatgcctggaatgtgtaggaccatcgtgctggctcc

SEQ ID NO: 5624 - DNA, 146 bp, Homo sapiens
ttttttttttttttttttttttgaacagatcaacaaatctttattaatagaaacagacagatggacagagaatgcagcaggggctgtgtgaaaactgtgatatgtgtgtgtgtgtgtgtgtgtatatgtgttgtgtgtgtgtaaaa

SEQ ID NO: 5625 - DNA, 588 bp, Homo sapiens
aacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctaaagcgtctttcatctgatttcctccaccatctggaaccttctggattcttccccttatgggtagtgatgggc

SEQ ID NO: 5626 - DNA, 630 bp, Homo sapiens; identical to SEQ ID NO: 1287

SEQ ID NO: 5627 - DNA, 465 bp, Homo sapiens
ttttttttttttttttttttgggtaacatgcaaaactttacttctctccccattcccagagcattgtgtcggaagaggtgagggtctcggctccatgcagtcatttggggcccctgggtctgtggcactgccatctttaacgcatggcatccaaatctaccatggactagaacagtaaaaagaacagattacttaagctggaggtagcttccatctcgcccaccaacacaggcttgggcagaactcacaggtgcaaggagaccttgggctgtaatttggctgtgtgcccaggaaaaggagaaacacggcattagtgagcaacgacattctctgccagtttcctgttgtaaaactctttcaaatttccacgcctactcttaggtgatctaatccaaatctgaactggcccacttgtccataaacatggcgaaaacttagaagctgctgagccctgcccacccagct

SEQ ID NO: 5628 - DNA, 467 bp, Homo sapiens
agtagacgaaggcggcggcgatggcggcggggatagtggcttctcgcagactccgcgacctactgacccggcgactgacaggctccaactacccgggactcagtattagccttcgcctcactggctcctctgcacaagaggaggcttccggagtagccctcggtgaagccccagaccacagctatgagtcccttcgtgtggcgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcagtaaaaatgttcactgcaggtattgacctgatggacatggcttcggacatcctgcagcccaaaggagatgatgtggcccggatcagctggtacctccgtgacatcatcactcgatac

SEQ ID NO: 5629 - DNA, 464 bp, Homo sapiens
atacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagggattattttacgggtttccatgtatctcactttgggctgtattaaaaaaacctcctttttaaaaatcta

SEQ ID NO: 5630 - DNA, 460 bp, Homo sapiens
tactgtgaatctgaaataagtggtctcaagagaagcattctccttgggaaggtgtttcagatcatcttgctcacaggggaccaaagtcacaaaagcccttcagaaaaatgcaggaagaagaggaggaaagttggagcgccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaaga

SEQ ID NO: 5631 - DNA, 544 bp, Homo sapiens
tttttttttttttttttttttttttagagagacagtttttgccatgttgtcccagctggtctcaaactcctaggctcaagtgatcctcccacctcagcctcccaaagtgctgggattacagctgtaagccaccacactcggccaaaaatatcaacttaattgtcatatgaatagcttctgtgtggcaaaaatggttaagacaatagaaataaaagatttaaggttgtgataattcatgtaacaaatgtatacatagttacacctgaaatatttttgaacagctttgtacctctatcttgtcaacagtgacagagaaagagatgataaatggtaatgaacaaacaaatacattttgaatgctgcagctgccaggatgtatcttagtgagaactaaaccttcctttttgtaaatcagtgagattttggtggtagcttgttctgcagcataatttagcatctttctatctctgaagtcagtcagttatggagtatagttaattctacagaaatatctgtttaatctgctttctttttcttctaccct

SEQ ID NO: 5632 - DNA, 230 bp, Homo sapiens
ttttttttttttttttttttttccgtaaaatgtaatataaagagttttagctgtgtcttgattttcctgcattttcatttcccaaaataatgaaacaaaaatctttggaaataaagaaacaaaaggtttggataaagaacagcccaggtgagtgacaaccagcctccagatagcacaggtaagtgttgtagaagctgtaagtgtagctggagcacatggaaaaagtgtgc

SEQ ID NO: 5633 - DNA, 438 bp, Homo sapiens
ttttttttttttttttttttttgtagtgcattttttagtagttccaactactaatcatcaactttgttttttatctacaacctttatttcacttacttttgagatggagtctcgctccgtcgccaggctggaatacaatggcgcaacctcagctcactccaatctccgcctccagggttcaagcaattgtcctgcttcagcctcccaagtagctgggactgcaggtgcatgccactgtgcccagctaatttttgtatttttagtaaagatggcatttcaccatgttggtcaggatggtctcgatctcttgacctcgtgatctgcccaccttggcctcccaaagtgctgggattacaggcatgagccaccacacccagccatttcatttactcttgagtatcataatactttatatggacatggaattctaggttggta

SEQ ID NO: 5634 - DNA, 597 bp, Homo sapiens; identical to SEQ ID NO: 1294

SEQ ID NO: 5635 - DNA, 502 bp, Homo sapiens
ttttcgctgactacattcagcccgtctggtaaacttgtccagattgaatatgctttggctgctgtagctggaggagccccgtccgtgggaattaaagctgcaaatggtgtggtattagcaactgagaaaaaacaggaatccattctgtatgatgagcgaagtgtacacaaagtagaaccaattaccaagcatataggtttggtgtacagtggcatgggccccgattacagagtgcttgtgcacagagctcgaaaactagctcaacaataccatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaaggactatgtgaatgggaagactttccttg

SEQ ID NO: 5636 - DNA, 291 bp, Homo sapiens; identical to SEQ ID NO: 1295

SEQ ID NO: 5637 - DNA, 588 bp, Homo sapiens
tacggccgggagggaggtgtccctgagaaggaaagaaggaaggtaaccccatcatatctctttggaaacatgctaatgacagatctcctggcaaacacaatcatcatatttactagtgggagagatttatctctgaatgcttttggcagaatacacctggtttgtctaggattgctgttgggaatcaaacctggaatctatggatttatgtggcatggctctttggaaaatgtcatctaagctctgttaactattggagtgtaaaatggagatgtttcatgaacgaagcaactcccttctgttagagacctcatgtattaatggaccaaagcatgtagtcatgcatattctcatgtgacaagaaagacctggggagctgtatgtgtgtcctcaaacctcttccgacttctcccatgcctttcagtgacatctgtccttggaattattagtaaagcttgattctgggtaagagctctgatatgtatgattcagatttgacattctgataggacattgagggattttttttttcctgaagttgaattttaacattgccttttgatttttattttaaggaaaggttgaaac

SEQ ID NO: 5638 - DNA, 571 bp, Homo sapiens
aagtcttagttttttaaactggcacataaaacactttttgctgttatttttatttatgtcaatactgcagagtatctttatgccttattcaagtggattctgagcctgtacgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatgtcccagatgatatacacaatatggtacatttgtgctctctctctctgtttttctctctttctctttctagttagatcaagataacgatgacttgtaccctccctgattct

SEQ ID NO: 5639 - DNA, 633 bp, Homo sapiens
aggtcacagctcgctaattgtttttccaagtctcaaggctttttcttggcatgtccagacaacctatccagttttactccctcctacccttacgcttatatcatcttattgccaaccataccacagtccttctttctgaacttgatttttgttactcagctaggagtagcctttccttttttaagggggtaggagttcccaagtcttacaactcaggtcccagcttaaactcctctgtcttgaagatgacttccttggctgcttcaacacctattaggctttcttttcttgacctcccggagaatgcattgggtaagattcagttttctacccaaatttaatgtgtctgtatttgtgtgcaacacacaaacttcattatttttatttgaactcttggctgtgcttgcatatgtgaaagtgatatttacaaattttggaacacatctttcaatacaatttgtgtccattatatacactgtactatgctatagggcatggagtatacagctgtaatagagtgaaggacacattgtctaatattgtagctttgtgtgtacaagtcccataagagactgtttaaaaaagtcttttagaaatttcactgggcatggtggctcacacctgtaatctcag

SEQ ID NO: 5640 - DNA, 593 bp, Homo sapiens
ctgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcaggccaacaaatctggctctggc

SEQ ID NO: 5641 - DNA, 603 bp, Homo sapiens
cagttgcgcaataaaagctgacagagcagtccaacaccccgcttctcttgcctcttactgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatgggtaatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaac

SEQ ID NO: 5642 - DNA, 631 bp, Homo sapiens
gcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaata

SEQ ID NO: 5643 - DNA, 589 bp, Homo sapiens
ctatacggtgaaaatcagtaattatggatgggatcagtcagataagtttgtgaaaacctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagtagcaagccaaaggagacacggaattttgagactttaaagtcgttttgggaactgtgatgtgatgtggaaatactgatgtttccagtaagggaatattggtgagctgcatatataaatttgacagatagctatttacatag

SEQ ID NO: 5644 - DNA, 626 bp, Homo sapiens; identical to SEQ ID NO: 2576

SEQ ID NO: 5645 - DNA, 569 bp, Homo sapiens
ccaagtaatgattagcaaatacagtacacataaaacatgggcatttgttctggaaagggctttctcctgctgatattgcagatagtttcacaggtcacagaaccttaaaaaggatttaaagggcatgtcttgtgtagcatttgttcctttgaaaatgatgctcctttcccattttttagtaattgaagaggatagaaaggttttctcattgcttacgtttcactgaattctctgcagccccttttcccacagatgtttcagccaaacctgtatggagggaggtgacatggcatggcttgctgtttaaaacagctacggtattttgtgcttcccttttgagtgtgtcaaggtgaacaaaaggagagcctctagaacgcatgggagggaatttgggacaggaccttttgcatgctgggggaaactgacaggactcagtgaggaaagaattttgtttgtgttttcttctctctctttctctgcagagcgcatgatctatatcaacatgcttcctggttatactaaagaatctcagctagtggtgatctaccagtttctgtgaggattattac

SEQ ID NO: 5646 - DNA, 458 bp, Homo sapiens
tttgaggacagggactatgtcttatgcaatcactattattgtcctgttacctagcatgggacacgtcacaacgcatatttgttcaatgaatgaatgaatgtcttctaaaagactcctctgattgagagaccatatctataattgggatgtgaatcatttcttcagtggaaaaagagcacaacggcacaaccttcaaggacatattatctactatgaacattactactgtgagactctttattttgccttctacttgctctgaaatgaaaccaaatcaggccgctgggttccacaagtcaatatatgttggatgacgattctgatgccttattgggaactgtgagacttatctggtatgagaagccagtaataaacctttgacctgttgtaaccaatgaacattatgagtatgttaatatgatgtaaattgctatttaagtgtaaagcagttctaagtt

SEQ ID NO: 5647 - DNA, 424 bp, Homo sapiens
tatttctcttctgtgagtaatgagtttcattatttcatttattttggtgctatttttgtttgtttgtttgtttattgttttttttttcttttttttggagacagaatcttcctctgttgcccaggctggagtgcagggatgtgatctcagctcgctgcaacctttgcctcctgggttcaagtgattctcctgcctcagcctcccgagtagcagggattacaggcatgcaccaccacacccggctaatttttgtatttttagtagagacagagtttcaccgttttggccaggctgatctcagattcctagcctcaagtgatccgcctgcctcagcctcccaaagtgctgggattacaggcatgagccaccacaccctgccaattttggtgctatttttaaattaggatatcactgggaaagggaa

SEQ ID NO: 5648 - DNA, 539 bp, Homo sapiens; identical to SEQ ID NO: 1301

SEQ ID NO: 5649 - DNA, 555 bp, Homo sapiens
ggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccacactggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatctgtacaaaggcatggggctgtccatgggcaccatgatctgtggctgggataagagaggccctggcctctactacgtggacagtgaagggaaccggatttcaggggccaccttctc

SEQ ID NO: 5650 - DNA, 523 bp, Homo sapiens; identical to SEQ ID NO: 1303

SEQ ID NO: 5651 - DNA, 105 bp, Homo sapiens
tgaaaatacggagtagcttgggaggtgtggacgcatgctaaaggaacttgtggaggacagtgtcaagctacttccctgtggatctctttcagtgaaaatgactga

SEQ ID NO: 5652 - DNA, 560 bp, Homo sapiens
tctctttttcttgtctcactgcactgactagcatcttcagaatgatgctgaatggttagagtggacatcattgcctggttctggacattagctgtaggtttttcgtagagtaggttgaggaaataaattctcctctgttcctgtttgctgagagtttttgtcatgaatgggtgttgaattttgtcaaatgcttttcctgtgtctgttgagataatcatttggtacttctccttaattttgttaatatagggaaataaattcacgtttcaatgtaaaccaaccttgcattcctaggataaactccaattggggtttctattttttattaaagaatttaattcttattaaatatttatatgttcataaggaatatttgtctggaggtttatttaatgtttttgtctgggtttgtcattaaggaatgctggcctcctaaaatgaagtgaaaagtgttccctcttgttttcttgaggactttgtatatgattggtctttgattaagtctttagttccctagtgaagtcacacagacctgaaattttctttgcaggaaattaatt

SEQ ID NO: 5653 - DNA, 352 bp, Homo sapiens
atggtattttttccattttacaaaggtagaaggtaaggcttagagaggtagagaaattctctttatatcatattagtaatgattagtagcttaatatttatttagcacttagtatctatcaaatacttaaaatactttagttatttatatgcattatctcatttaatccttacaacacccttatgaagtaggtgcttataaggctattatctcattttacagatgaggaaatgaatgcacacatatatttagtgacttgctcaaggttcatagctagtaagtagagctgaaaaacaaacgtggagaattggactccagagcctttattcctctgaattgcctcctgtatgat

SEQ ID NO: 5654 - DNA, 96 bp, Homo sapiens
tcctgcccctagacccttgagccactattcataactcccctgcccttgtctgctctaaggagtttctgaactccttcatctctccttagctacctt

SEQ ID NO: 5655 - DNA, 639 bp, Homo sapiens
agctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatcagaggatacctttgcctccacctcctgcaccagaaacatacgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtctttcttcgtggtccccttcttctcccaccttattccattcttaactctgcattctggcttctgtatgtagt

SEQ ID NO: 5656 - DNA, 551 bp, Homo sapiens
aaaccgtcatgtttctggggagtcacctcagctggcagttaccaccgtgttggaaagcagcctcaggaccggccacctccatcactggcgtcaccatgggggctgtgctgggtgtcttctccctcgccagctgggttccatgcctctgtagcggtgcctcatgtttgctgtgtagttgctgtcctaacagtaagaattccacggtgactcgcctcatttatgctttcattctcctcctgagcactgtcgtatcctatatcatgcagagaaaggagatggaaacttacttgaagaagattcctggattttgtgaagggggatttaaaatccatgaggctgatataaatgcagataaagattgtgatgtgcttgttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccct

SEQ ID NO: 5657 - DNA, 578 bp, Homo sapiens
cggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagca

SEQ ID NO: 5658 - DNA, 547 bp, Homo sapiens
taggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatgga

SEQ ID NO: 5659 - DNA, 560 bp, Homo sapiens
acatcatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcgtacttgcatctttaacatgctatcatagtacatttagaatgattgcctttgattttttttttaaattctgtgtgtgtgtaaaatgccaattaagaacactggtttcattccatgtaagcattaaacagtgtatgtaggtttcaagagattgtgatgatttttaaattttaactaccttcacttaatatgcttgaactgtcgccttaactatgttaagcatctagactaaaagccaaaatataattattgctgcctttctaaaaacccaaaatgtagttctctattaacctgaaatgta

SEQ ID NO: 5660 - DNA, 172 bp, Homo sapiens
tacggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagc

SEQ ID NO: 5661 - DNA, 593 bp, Homo sapiens
tatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgct

SEQ ID NO: 5662 - DNA, 613 bp, Homo sapiens
ctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggtccacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtggga

SEQ ID NO: 5663 - DNA, 504 bp, Homo sapiens; identical to SEQ ID NO: 1310

SEQ ID NO: 5664 - DNA, 660 bp, Homo sapiens
  misc_feature 112: n = A,T,C or G
gccggggtgaagtcttcgtcttaatgatggtggagaagttgatttagaccttggaaattatgaaagatttttggatattaatctttataaagacaacaataccaccacgggngaagatatatcagcatgtgatcaataaagagaggcgtggtgattacctggggaaaacagtgcaagttgtccctcacattactgatgctgtccaggagtgggttatgaatcaagccaaggtgccggtggatggcaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttcccataccgagttcctgtgcttttagaggaacaaagcattgtgaaatattttaaggagagattgcacctgcccat

SEQ ID NO: 5665 - DNA, 676 bp, Homo sapiens
gcaggtggtggtgaagtcctaaccagtagcctccgctgacactgctcctgtaagggaggggaaaggacacatcattcccccagtgccagtccaggttcctggaacgtacacagtctccattgacagtgtgagagggggagggtcaccactgatttttaaaatctcattttaatatttcagatatttccaattataagtaactttaatacttcatatgtttacttttttggttatattccttttagatctacagatatatttagttttttcatactagttttaacaaagctcagagcttacaattttgtctggtgttgtagcgtcacatttgagaactgctaatttgcttttcagatgtgagaagaagagaataattgcaaagtgtgctgtagatgaaagagtctaatgcttttgtagatattttgtgaaaggcaatgaaagtataggtctggttttttaaaaaatggaaatagatggtgcttacattcctacttgattcttcaatttataacaacccaattataaatattactttttgttccagattttttacagaatcaagtgtatgtttgtataaggctacattggcatgagcattagaatgtcaaaatattcacatttccttttcaaatttaggatgtagtttattacatttctggaattatgcatatgcgga

SEQ ID NO: 5666 - DNA, 580 bp, Homo sapiens; identical to SEQ ID NO: 1312

SEQ ID NO: 5667 - DNA, 510 bp, Homo sapiens
gtcctggtttcggggaggggagccaaactgctccaggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcccgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctagatgtgagcttgcagagcatcttgcgccctgacccaccccagggcctgcgggtagagt

SEQ ID NO: 5668 - DNA, 645 bp, Homo sapiens
tctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataacagggatgtactggaaagctgcagagggccattgtaagtattctgaattatgtcatcta

SEQ ID NO: 5669 - DNA, 574 bp, Homo sapiens
tttccagacaaggaggaaaatgatggggtactgtgcccagggattaggggagctgagggtaagtactcttctgacttttcccccacaagctgctaaaaagatcattgcttttcgttatattttggactggtatacctggctaatcagcattcactggcaaacagcactgtgaggaagacagctgcctaaggcctgtttgtcaccctggaagggaagcagcagagaggtagaagtatcctgagagaagaaaatagtgtcaagagggagaaagcagcagctcccatcaagcccttaccacatgctgtgcctggactttggtatctcatcactttgggtgaagaaactcaggctcaagaagttaatctctcttgattaaaccccttgctttgagcctcagtgaatttgtttcacaacccattagacagacagttgtaggtgaggtgactacattgctacgggctcattcagttgctggactgaaagccatttggagctccagctgatagggattatgcagctccacatgagtgggttgggtcagtcatgtctgtggaatgagatgggtggaatgaga

SEQ ID NO: 5670 - DNA, 565 bp, Homo sapiens
tccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgcttatattactggtattagtcttagcctaatgaacctaattatttttctttctgtattctttgcttcctcaaatagcatctgcagcaattggaatgagaaatccagatatgtgtttcaagtagtacattgcctgaatacaaatcacttgacacagtattgtatataatccctgatcctatttgtttcat

SEQ ID NO: 5671 - DNA, 498 bp, Homo sapiens; identical to SEQ ID NO: 1317

SEQ ID NO: 5672 - DNA, 615 bp, Homo sapiens
tacggccgggcgcggtggctcacgcctgtaatcccagcactttgggaggccgaagcaggtggatcatgaggtcaggagattgagaccatcctggctaacacggtgaaaccccatctctactaaaatacaaaaaattagcccagcgtggtggtgggcacctgtagtcccagctactggggaggctgaggcaggagaatggcatgaacccgggaggtggagcttgcagtgagccaagatggtgccactgcactccagcctgggtgacaaagcgagactccatctcaaaaaaagaaaaaaaagaaagcattgggaaagcctaaatggtctacaggccacttggaagagaagtgacacaactctcagaaagggaaagaatgaatgaatgaaagaatgtgctttctggggaggaacagtcagcatttttgataatttctgagaggcaggtcagtagagtagttaagaccatgaacgctagggccagattctgcttcttcatatttttacagccttgggaaagttattctctctgtgccacactttgtttatctgaaacatgaagacaactacagcatcttctttacagagttcttctaaaaattaaatgagttaattttt

SEQ ID NO: 5673 - DNA, 545 bp, Homo sapiens
gagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattgactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccc

SEQ ID NO: 5674 - DNA, 456 bp, Homo sapiens
tacggccgggtggcaagccaggtaacataaatgtgtgaaaaagtaaagataactaaaaaatttagaaaaataaatccagtatttgtaaagtgaataacttcatttctaattgtttaatttttaaaattctgatttttatatattgagtctaagcaaggcattcttacacgaggaagtgaagtaaattttagttcagacataaaatttcacttattaggaatatgtaacatgctaaaacttttttttttttaaagagtactgagtcacaacatgttttaaagcatccaagtcccatataatccaactatcatggtaaggcctgaaatcttttaacctaccaaagcctaaatgagacaccgaattaacattaaaatttcagtaactgactgtccctcatgtccatggcctaccatcctttttgaccctggtttccagggacctatgtcttttaatact

SEQ ID NO: 5675 - DNA, 547 bp, Homo sapiens
tacggccgggtgacaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggag

SEQ ID NO: 5676 - DNA, 565 bp, Homo sapiens; identical to SEQ ID NO: 1323

SEQ ID NO: 5677 - DNA, 622 bp, Homo sapiens
cggccggggatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcaatgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggaga

SEQ ID NO: 5678 - DNA, 300 bp, Homo sapiens
cacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatgg

SEQ ID NO: 5679 - DNA, 565 bp, Homo sapiens
tttttttttttttttttttttttgagatcaaggccatggggccagagatgagtccgttttaattgctggggaaacagggaggggccttggaaatagctccccccaccccactccccacgtgtcccatccagtttgggcaggaagccactttccctagaacagttcactgctgggatcctgtgaagaaccgctgtggagggcagcagctggacgagggcacaggacctcagagaacactgatgcgctccgccagcccctgcatgtcgtggtcctgtggtggacaggccccaccgagatccctgtccgtgggcagcccagacccaggcagcggatgctctgctgcaaactgctcccagcgcgcgtcgtcactctcatgcgtgatgtatcgctctcccatcttcccctccagctctcggaggtcctgccacgtctggtactcctgtaaccaggggtggctgagagatttgtccacgctgtagcgtttgcgcatcttcacctgcagcaggttgttgatgaggtcaatggctccagctgagatgtggctccaggggctggccgggtacat

SEQ ID NO: 5680 - DNA, 509 bp, Homo sapiens
ttttttttttttttttttttttttttttttttttttttttttaagaccctcatcaatagatggggacatacagaaatagtcaaaccacatttacaaaatgccagtatcaggcgggggcttcaaagccaaagtgatgtttggatgtaaagtgaaatattagttggcggatgaagcaaatagtgaggaaagttgagccaataatgacgtgaagtccgtggaagcctgtggctacaaaaaatgttgagccgtaaatgccgtcggaaatggtgaagggagactcgaagtactctgaggcttgtaggagggtaaaatagagacccagtaaaattgtaataagcagggcttgaattatttggtttcgggtgctttctattagactatggtgagctcaggtgattgatactcctgatgcgagtaatacggatgtgtttaggagtgggacttctaggggatttagcggggtgatgcctgttgggggccaatgccctcctaattggggggtaggggct

SEQ ID NO: 5681 - DNA, 429 bp, Homo sapiens
ttttttttttttttttttttttttgctttcttctggagggttattttggataaaatagttgaagacagactacaatgagacattgtaaaataagactagaaaataatttaagagcgtattttaagcacgggattccgacacactcataaacgtgtttgctcccagctcttacaaaagaaaataaggtttttttccatcaaaaacaacccagttacaccagtaaatcttcccagttctgaaaatctgaagcaactgatactccattaaatgtggaaacactgtctactcaaaatatttgtaatattatgcagtgacaaaaatttcccacacctatatagggttaaccatagttttcagcaaagcaacaagggctttacttattttgtctttttcagtttatacagagctccaatttcatgaaaccatact

SEQ ID NO: 5682 - DNA, 124 bp, Homo sapiens
tttttttttttttttttttttgtggagccagcttaccaacataacactttgctgatattttgttcatttgtccccctaagttcatgaaggaaaatggtctatagttttcttgcagtgttttttg

SEQ ID NO: 5683 - DNA, 349 bp, Homo sapiens
aataaacttaaaagatatccacccattttgtcagatttatttattctttagcaatttaagtattaaaatcacagtttttgtctcaatccttaataatactatattcattatatttcatgtttagctttctcatggagaaaaagaaacacaggcataaacctatatactatccacctgctggttctgcaacatgattataataaagtgttactgacacttgaacaatttctatgatgtcggcagagatttcaacaagagtgattattaagtagctagccttataagtcaagagttatgatctttgatccactgctcaatccatttcaagatctgatctacattattttct

SEQ ID NO: 5684 - DNA, 523 bp, Homo sapiens
atgaatactttattagagacataacacgtataaaataaatttcttttcatcatggagttaccagattttaaaaccaaccaacactttctcatttttacagctaagacatgttaaattcttaaatgccataatttttgttcaactgctttgtcattcaactcacaagtctagaatgtgattaagctacaaatctaagtattcacagatgtgtcttaggcttggtttgtaacaatctagaagcaatctgtttacaaaagtgccaccaaagcattttaaagaaaccaatttaatgccaccaaacataagcctgctatacctgggaaacaaaaaatctcacacctaaattctagcagagtaaacgattccaactagaatgtactgtatatccatatggcacatttatgactttgtaatatgtaattcataatacaggtttaggtgtgtggtatggagctaggaaaaccaaagtagtaggatattatagaaaagatctgatgttaagtataaagtcatatgcctgatt

SEQ ID NO: 5685 - DNA, 508 bp, Homo sapiens
aaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttga

SEQ ID NO: 5686 - DNA, 441 bp, Homo sapiens; identical to SEQ ID NO: 1330

SEQ ID NO: 5687 - DNA, 527 bp, Homo sapiens; identical to SEQ ID NO: 1332

SEQ ID NO: 5688 - DNA, 467 bp, Homo sapiens; identical to SEQ ID NO: 1333

SEQ ID NO: 5689 - DNA, 564 bp, Homo sapiens
catgttaaaggtttatgaagccaggctcactgaggaggaaactgtctgcctggacctgtataaagtggaagcttaccgctgtggactgaagaaaataaaaaatgacttgaacttgaagaagtcgttgttggccactatgaagacagaactacagaaagcccagcagatccactcacagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctc

SEQ ID NO: 5690 - DNA, 493 bp, Homo sapiens
ttttttttttttttttttttttctgaaaggctcactcttgttcctaatagaaagacttagatggtatttcttcagatcataaagcaagttgtacttttaatgatggaataaaaattataaaagtaaaacgtggcttttcctccccattctttttttccttttttagatgatgaattcaggaaaagaccagtctaggccaaatttatctcttgttaaccttcagggatatggagtacgccaagtatgttagtacaaagtcaaatttggatgatgtagtcattttttgctaattccattattagaaacattagataatatggtagtatctaaagaatacagctttaaaaatagtatgcaccttcactatcaagactgtaaggcaaaatcaacttgtgcccacgactgaacttttgaaatagaaaattttgttatatccatgttagccaggctggtcttgaactcctgacctcaaatgacccgcccgccccgacct

SEQ ID NO: 5691 - DNA, 545 bp, Homo sapiens; identical to SEQ ID NO: 1335

SEQ ID NO: 5692 - DNA, 453 bp, Homo sapiens
ggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactga

SEQ ID NO: 5693 - DNA, 348 bp, Homo sapiens
acttgaggtcagaagttcaaaaccagcctggccaacatggtgaaaccccgtctctgctacaaaaattagccaggcgtgatggtggatgcctggaatcccagctactcaggaggctgaggcaggagagttgcttgaacccgggaggcggaggttgcagtgagcagagatggcgccactgcactccagcctgggtgacaagagcaactccgtctcccaaaaaaaaaaaaaaatttgcaaccaaagggggggggcatttaaaaacctttttaaacccagtccctaaaaattaaaagccttaaaccggggggggctttttaaaaccttaaaaccattaacccttggccttgg

SEQ ID NO: 5694 - DNA, 419 bp, Homo sapiens
gctgtaccctcccggtggagtcgggagggagggaggcagggaaggggacagggggctgcacctgtaataagcccttgttcccatgcacactagcaaagaaaggagagggagctttccccgatgaccctgctggaccacccccatgctcctgtgctggtgaggccgatggagagggatgtgggcataggacacgtctcaagatttccattttacaggcagccggacctgtcttcaggtcccttccttgttgacagacatgggtacaccagaggaagctgggcgctcggcctctgtgcagcctcatctcctgcaatctgagtattgaaaactgggcttttacttcgcacacctcaacacggacttccatgggaatccaggtcacagcaaagcagtcctgggcctacattctcctttaagca

SEQ ID NO: 5695 - DNA, 485 bp, Homo sapiens
tagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccaaaggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatacaaatactacaccattttctataagggacttgaacatcatggactttagtatcctagggggttcttggaacccatcacccataggggca

SEQ ID NO: 5696 - DNA, 608 bp, Homo sapiens; identical to SEQ ID NO: 1340

SEQ ID NO: 5697 - DNA, 520 bp, Homo sapiens; identical to SEQ ID NO: 1342

SEQ ID NO: 5698 - DNA, 648 bp, Homo sapiens
aagcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaa

SEQ ID NO: 5699 - DNA, 520 bp, Homo sapiens; identical to SEQ ID NO: 1344

SEQ ID NO: 5700 - DNA, 661 bp, Homo sapiens
tacggccgggagaacactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgagctgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacatagtctcctggtaaccacctcagatctctattattaggctagatgtatagcctctact

SEQ ID NO: 5701 - DNA, 355 bp, Homo sapiens
agcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtgaccgatgtgctctgcgagttcctggaggcggctgtgcatctcatcctctacgtgcgcgaggtcaaccccgtgggcatcttccagaaacgcaggaagtacaacgtgccggtccagatgtcctgccacccggagctgaatcagtatatccaggacacgctgcactgcgtcaagccactcctggagaagaatgatgtggagaaagtggtggtggtgat

SEQ ID NO: 5702 - DNA, 587 bp, Homo sapiens
tacggccgggtgcgatggctcacgcctgtactcccagcactttgggaggccgagacgggtggatcatttgaggtcaggacttcgagaccagcctggccaacgtggtgaaaccccatctctactaaaaatacaaaaattagctgggcatggtggcgtgtgcctgtaatcccagctactctggaggctgaggcacaagaatcacttgaatccaagtggatcacttaaggtgaagagttcgagaccagcctggccaacatggtgaaacctcgtctctagtaaaaatacaaaaataagccaggcacggtgatgcacgcctataatcccagctactcaggaggctgagacacaagaatcgcttgaacccgggaggcagatgctgcagtgagacgagatggcaccagtgcactccaccctgggcgacagagcgagactctgtctccaaaaagaaagaaaaatattgtggcactggggcatcaacttgattgaacgtccagaggattatagtctgctgtatatggccatccttggttttaccagtttttcagagctcagtctggggaaaagaaaaaaaaaattatacttcccct

SEQ ID NO: 5703 - DNA, 520 bp, Homo sapiens
gggctggtgaggaatggagccggtaggctgctgcggcgagtgccgcggctcctccgtagacccgcggagcacctacgtgttgagtaacctggcggaggtggtggagcgtgtgctcaccttcctgcccgccaaggcgttgctgcgggtggcctgaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccgaagaatttaacattagaaagacatcgactcactgaagtaggtcttttagataaccctg

SEQ ID NO: 5704 - DNA, 568 bp, Homo sapiens
aggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggatgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgatttt

SEQ ID NO: 5705 - DNA, 557 bp, Homo sapiens
atatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacccgaagtctgaacctatcccagagagcaatgatgggcctgtgaaggtagtggtagcag

SEQ ID NO: 5706 - DNA, 514 bp, Homo sapiens
tatttcataatagaagatcttataatccaaggctgagagtttttccagtcttttgtttacatcagaagactccatcttcttggtaaactgaataaaacatagtttgttttgtgccaaaaatgataagatgataaaactgtctgtgagaagagcatcactgatggtgtctgagatgagcttccccaccaggcttctgtcaatcaccactttctccagctgcggcccagaaaggcttagagacaccagcacacctgaaccaaaaaggagctgacagatatatttgttcttccatttgctcagcacacaccgactgttttgcatcagctcctccaactctttgagcgagtctcggagtttttctgggcgtctgtttttgagcgtccaaggataatctcgtgactctgccagcttctgcttcttttctaagttaccgtgctctgtcgctggtggatctttcttgtcataatactggtagatcccaatgtctctatccgcaatgtgtaaggtattcttc

SEQ ID NO: 5707 - DNA, 665 bp, Homo sapiens
cggctgtgtcggtgtatgctccaccagttggaggcttctcttttgataactgccgcaggaatgccgtcttggaagccgattttgcaaagaggggatacaagcttccgaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgcctcatgtcaccatgggttctggctccttggcagcaatggctgtatttgaagataagtttaggccagacatggaggaggaggaagccaagaatctggtgagcgaagccatcgcagctggcatcttcaacgacctgggctccggaagcacattgacctctgcgtcatcagcaagt

SEQ ID NO: 5708 - DNA, 665 bp, Homo sapiens; identical to SEQ ID NO: 1348

SEQ ID NO: 5709 - DNA, 588 bp, Homo sapiens
tacaatgtgggtgagcataacctatttcctggcccaatagacaactctgggctattttcagatcctgagagtcagaaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaaactagacaacactgtccaggatgctgggctataccagggtcaggtgctagtaattgagcctcaaaatgaagatggcacatggcccaggcagaccttgcagtcaaagtaagagaattttttctcccttgttgtaggctcacatgtgcaaaagagacagtctttcct

SEQ ID NO: 5710 - DNA, 723 bp, Homo sapiens
gccggggcccgcccggctgctcctggcgctgtgcgaggccgcgggctgcgggagtgccctgctctggcctcgcttgttgctcttcggggactccatcacccagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccaccttgtgaaacagcctgggaagaacagtgcatcatacaaggttgcaaactaaatcgcctgaactctgttgttggtgaatatgccaatgcgtgtttacaagtggcccaagactgtgggactgatgtacttgacctgtggaccctgatgcaggacagccaggacttctcatcttatttatcagatggactacatttgtctccaaggggaatgaatttttgttctcgcatctctggcctttgatagagaaaaaggtctcttctctacctttgctgcttccttactggcgggatgtagca

SEQ ID NO: 5711 - DNA, 606 bp, Homo sapiens; identical to SEQ ID NO: 1351

SEQ ID NO: 5712 - DNA, 671 bp, Homo sapiens
ttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagt

SEQ ID NO: 5713 - DNA, 601 bp, Homo sapiens; identical to SEQ ID NO: 1353

SEQ ID NO: 5714 - DNA, 440 bp, Homo sapiens
ctaaagaaaatgtacatatatgccatggaataccatgtagccatcaaaaatgaaatcatgtcctttgcagcaacatggatgcagctggagtttattatcttaagtgaattaatgcaggaacagaaaaccaaatattgcatgttctcacaagtgggagctaagcattgggtacacatggacacaaaggggaacaatagacagtggggcttacttgagggtggagggtgggaggagtgtgagggtacaaaaactacttaccaggtactatgttcactacctgagtgacaaaatcatttgtataccaaattgctgtgacacaatttgcccatttaacaaacctgcatgtgtaccccaaacctaaaataaatgttggaattaaaataaaactcatattaaagttttaaaaaagggctttgtattaggtaattttacctaaacgt

SEQ ID NO: 5715 - DNA, 620 bp, Homo sapiens; identical to SEQ ID NO: 1354

SEQ ID NO: 5716 - DNA, 627 bp, Homo sapiens
ccgggggggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatg

SEQ ID NO: 5717 - DNA, 590 bp, Homo sapiens; identical to SEQ ID NO: 1355

SEQ ID NO: 5718 - DNA, 568 bp, Homo sapiens
caaaacctggcgtcgctcaaagtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatctgctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtctgtggagtttgcagactgctgtttaggaattgtggggccatcccagaatgaggagtcttaagatggattattgtgctgcttgctcaagcgtgtgcttgactcctggaacctgcctgctccctctcccagaccagctagtttggggctggggagctc

SEQ ID NO: 5719 - DNA, 448 bp, Homo sapiens
tgttcatttatgcactcatatgatcatttactcattaataaatattgattaaatgcctgccttatgacaggcactgtgctacatactggaagtatgaaagtaaatggtaccaatatatagtcccaatccctgatacctatatgatctagttgagaaagtggacatgaaaatttttaaaaaatatttgcagcatggctaggctttaatagagacacactgcatggctcagtctcagcacactacttctaccacgcaggtctttttcacttaactccatctggacagctttgttctaaatgactaaatttattttttgaaaagtctacacccctccagaattagttagaaaagaatagctagtttctgcatctcacttagctctcgtgtctaagcattttttccagctcttcccagactcttgagtttgagtttgaccatctttaaagct

SEQ ID NO: 5720 - DNA, 610 bp, Homo sapiens
cctttttagggagtccaggtacagtcgccgcgtgcggagcttgttactggttacttggcctcatggcagtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggc

SEQ ID NO: 5721 - DNA, 587 bp, Homo sapiens; identical to SEQ ID NO: 1357

SEQ ID NO: 5722 - DNA, 499 bp, Homo sapiens; identical to SEQ ID NO: 1358

SEQ ID NO: 5723 - DNA, 546 bp, Homo sapiens
cttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattacagccttattaaagtggcagcatcttgtggggccatccagtacatcccaactgagctggatcaagttagaaaatggatttctgactggaatctcaccactgaaaaaaagcacacccttttaagactactttatg

SEQ ID NO: 5724 - DNA, 606 bp, Homo sapiens; identical to SEQ ID NO: 1359

SEQ ID NO: 5725 - DNA, 441 bp, Homo sapiens
gtggaaatcgactgcaatttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagaaggttctgtggaggacataagggagatagtgcagagactgaaggtaagggagagagcccggcgatagggcggcgatttgtatggtttcggcctcaggaaccactgaaatacttccctagcccagtcagttaggctaagacacgcactggcccggagagaatcacagttgtcacttacaaactagacatcttgtgggttctgtagctaggttcttcctctggaaggtttgtgccagagatctgtggatcttcatgctattacctcg

SEQ ID NO: 5726 - DNA, 628 bp, Homo sapiens
tggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaact

SEQ ID NO: 5727 - DNA, 346 bp, Homo sapiens
ttttagattatggtaacaatatataatgcctggcataggcagattcaagaaagtttttgattctaaggactttatgactttacccaggcttttttttctgtgagttttctattttcagagtgttggtctgcattatatctaagagactagaagctgcctgatagactaactgcatctggtcccttggaaataatttatcaagtcaacatcgactgctgtggggttctagatttagccatgctgtttattcctcattttgtttctgcagttgtctgagtgctgatctttctttctttctttcttttttttttttggaaaacattttctttttttcccccaggggggg

SEQ ID NO: 5728 - DNA, 570 bp, Homo sapiens
tacggccgggtatttgacagcacagcagggtgactatagtcaataatttcattgtacgtttgaaaataactaaaagtataactggattgtttgtaacacaaataaatgagaagagggataccccattttccatgatgtgattattaggcattgcatacctgtgtcaaaacatctaacgtatgccataaatatatatacctgctatgtacccataaagattaagaattaaaaaaaaataaaagccgaagggcctacagtgcagcaaggcagatgagatgcatccatggaaatgtgaaataacaagtcacagatgctatgagtcagaatgtgtgctgtaggaattcaaacccagaaagcttacttctaagaaggaaaggaaaggtgctgttggagctaagcctcaaaggggagctgaagtttgtatgtgctttttttttttcaaaggtccttgtttttccaaataaaatattgggcagtccaacaaactaaggggaaaaaattcaggcaacgtgacgtgaaggaaaaaaatttttgggtctaaaatgctcccaaaaagggtttgcctaaggg

SEQ ID NO: 5729 - DNA, 643 bp, Homo sapiens; identical to SEQ ID NO: 1367

SEQ ID NO: 5730 - DNA, 371 bp, Homo sapiens
tttctttttcagagatcagaaaaaaaagaaaaaagtcctgaaagaaatggtacagacttatttcaagataaattagaaaccaagtaaaatcagtgtatttttgctaggtacttaaaggactattttgtatcttttaaattatctgttcatcttttaacttgctcatatttataaccttttcacgatgaatgatattagaatacatgactaattatacagaataattttctttttaatttcatttataggagaacctttacaaatagatcacttggtttttgtagtccatgggattggaccagcttgtgatctccgctttcgaagcattgtacagtgtggtaggtttgcaaagcatgtgagagaatattaat

SEQ ID NO: 5731 - DNA, 441 bp, Homo sapiens
cggccgggtgtggtggctcatgcctgtaatcccgcactttggtaggctggggtgggtgggtcacttgaggctatgagggcgagaccagcctcacctacctggcaaaatcctgtctctactaaaaatataagaattagccgagtgtggtggcacacagctgtaatcccagctactcaggaggctgaggcatgagaatcgcttgaacctgggaggcagaggttacagggagccaagatcacaccaccgcactccagcctgggtgacagaggagactctgtattcaaaaaaaaaaaaaggggccctcccccaaattttttcttttttaaaaaaaaacaaaaaaaaatgccttttaaagaaaaaagggtggggaaatttcccccaaaaaccgttttttaaaaaagggccccaaccaattttaaaatttgattttcaaattaaaaa

SEQ ID NO: 5732 - DNA, 816 bp, Homo sapiens
acagtacaaagtttgaaaattttattggaaaataagtacagtctattgatccgtgatgcatgctgtacatgaatttggtgctttaatatacaaaaaatttggcttctgctgcaaaattatataaacaggttaaaaaaaactccttcatcaactagtacaaacataatttatcaaaaatgtcatttaaaaaatggctcaataccttttattgcaaataagaaaggcaagagagggaaaatataaattgtgctaaaccagttttaacaaccggtaattaaatattttgttgcatttgcaaactcttcttcaacacttagggcatctttaaaaaaatgccataaaaaactgcaagaaaatctaattaatgtggaaggcattaaaagttttttgttttgttttagtggggacaataagtcaaaggaagttcacggggaactaggaatgtgtcttcttcctccagaattcaacccttggaagatggggaataactttgcacttatctgtttggatcttcctccacccacgcttatccattgattcgtgtcactccttagatttcagcctgcattctacttgtaattcttggtcatcatcacgcccactctctgggccagttttgtcactaacctaagtttccataattggcttgctttcgtagccctatggcagctgacccattttcgggatgtcagacaaaatcatcctgccaatttagtttggaaagcaccactgtggctttcaagacgggacaacccgtccccagggctccctgtcgtagtctgtgtgtcaaaggaaagctatggcccgtttgtggga

SEQ ID NO: 5733 - DNA, 567 bp, Homo sapiens
  misc_feature 490, 511, 543, 551: n = A,T,C or G
tcaccaggaaccgtttatggccccacccgccccactcagagctgctgagcaatctgctctatcctctgcagcgtctcctctgattctagctgctccaggctgagcagggacaggcccagctgatcctcccggtggaagggctgtgccatctgccgcaggaagtacttggccacctggacaccctcatccacggtcaggttgaggttggcatctgtgaggtgctcctggatccagcggggcagcttcccccgcttgtccccacgggcaaaccgcttgtcggcaaagaccatgaggccgtagtccgtcttgcccctgatggcccgacccacacactgggccgcgtggcgcatggcatcgaaggtaagaaagtcattctcacgaatctggaactggtcccgcaggtattccagccgcgccttgagaatgcggctctgtgtgtagacgtaggggacgccaaacatgatgacggccccgccgtagtggtgcacanagtcgattcccctcgacactntgccccgggccactgacagcaggatggccccngcgccatnctcgcaggccctctgg

SEQ ID NO: 5734 - DNA, 667 bp, Homo sapiens
ggtttcttgttttttattattggcgtcagctaggactatacgtggccttaaacgtcatgcactgatggacagaagagaaaaaaggatgaaaaaaaagacaaaggaggggaaagaggagcagcagtgaaaatttgtaataaaaactcttcttaatttataggtaagttttggcatttttaaatccaacgccccctcccaccccctaaagttccaaccaaagtgagagggtcacagggtgacccggccaggtgttctgcacttccttacaggctgctgtcagaggcagcttgtgggtttaattcttttgtatgtgttttacatttttcactttctttaaataattgcttcttgactcttagacgttccggttcacgggggtgacataattgcggggaaacatgccggtctgcccgtggcaagctcctttccaccagttggggtctgagttatccatgacatggataaaatctccccggcggaagcccagctctccatcctcctggggatcaaagtcaaagagggcctggacgtatgtcggctgctgtggcacctgttctatgtcccgcaggaatatctgctggtttctggagacagatgtagatctgtgataatccaccagctcattcaaagaattgaactcaccacccagaagagtacttccgggctc

SEQ ID NO: 5735 - DNA, 270 bp, Homo sapiens
ttggtaagttttttatatttttttcgtaggggttttatttaaatgtcctttgaagtatgcttgaggagggtgacgggcggtgtgtacgcgcttcagggccctgttcaactaagcactctactctcagtttactgctaaatccaccttcgacccttaagtgtcatatgggctatcgtagttttctggggtagaaaatgtatcccatttcttgccacctcatgggctacaccttgacctaacgtctttacgtgggtacttgcgcttactttg

SEQ ID NO: 5736 - DNA, 133 bp, Homo sapiens
ttttttttttttttttttttttttgcaggcaccaagatttttatttacccaccttcctgctttcttttaacattataggccaaattattctctttttgacccagggttgtgaaaggaaccatctggttataaa

SEQ ID NO: 5737 - DNA, 441 bp, Homo sapiens
ttttttttttttttttttttttttccagtgccgccgcctttattcccagaccctcgagctccacagccacacagacacttagctttcagagggcacaggaaggaaaagggacctggtgaccctcccagcacaccccatagccaagacagacccagcagcagcacctcagggtcagcctgggtgcccctgcccaggggccactgtgaccgcagacaccaggaggccaggcctggttgctggggacccccttggggggcccggcagtatcctaggcccaaagagctggtgccatcttgaagctgattcagggaagaggccaggctggacggtaggggtaggtgtgagaagctccccagcgtgtccaggccacgggagcagcaagggtctgcggggagcccatgctggatggggtggggctgcccctgtcctgtatcctgacca

SEQ ID NO: 5738 - DNA, 458 bp, Homo sapiens
ttttttttttttttttttttttttgagacagagtcttgctctgtcgccaggctagagtgcagaggcgcgatctcggctcactgcaacctctgcctcctgggttcaagtgattctcctgccttagcctcccgagtggctgggactacaggtgtgcaccaccacatccacctaatttttgtatttttgatggagatgagatttcaccatgttggccaggatggtctggaactcctggcctcaactgatccatctgccttggcctctcaaagtgctgggattataggcatgagccactgcatgaggtcttaaaatatattgaaagcaaaaatactctcgtaactgaacatacccaggcaatctctctcacctcaacatggacaacagtaaacaggagttatttatgttgtggatctgaagccagttcttaccttgagaagtctagtctgctctttaaaatc

SEQ ID NO: 5739 - DNA, 217 bp, Homo sapiens
ttttttttttttttttttttttttcggggggctctaagtctttattggggagaatacccacccaccttccctcactgcagacgatagacacactcagtgtcagggtagggtggcaggttcagctggtacttcttttccagagcaggtggcacaaaacgaccccccaggtaatggtagcgaccggtaaactgggttgcagattttttgggggctgtga

SEQ ID NO: 5740 - DNA, 596 bp, Homo sapiens
tttttttttttttttttttttttgagtcaataatgtattatacatcttagatttatacatttcatatatgcctttaaagcttcaattaacagttcaatacaaaatttaaaaacaaatatatgcagcagtggttctcaggcacagaactgaggaggagactggagcaagtcttttccctagcatacatacagtgaatactatgaaccatgagagtggtatgtttccttctgacctagctgcctttttgattgaattttgttacaatgaacagctttaataggtatgatattgctaactggaaacaatgagatttaaaataaattgataacctgtattttcttgaagtctttaagacctaaaatgattacttttctcctaatagagctccagaatcatccaatgaaaataatattgtccataaagcatctagagtatctgcctaagaaccactgcccagggttattcaatgtcttcaggcctcacaggatgaggtaatggtatgatggatttcttctcagtatccctggaaagtgctttcctcatatcataagcgtcctcatcaggctccccgttgctggtcgaatagtactctatga

SEQ ID NO: 5741 - DNA, 193 bp, Homo sapiens
ccaggagtaatcttttatacaaccggttccttcaaacaataatgaaatattcattagcaacagaaattcactgctcctccaacacagttctcaagataattactgatgatatgactcagctgaatctcacaggaatctctccctctctctctctctctctctctctctctctctctctctctctctctctctc

SEQ ID NO: 5742 - DNA, 539 bp, Homo sapiens
ttttttttttttttttttttttttttagctgagacacgttctcactctgtcacccaggctggagtgcagcgccatgacctcagctcacagtagcctcaacctccttggctcaagcaatctcacccatttcagcctccagagtagctgggaccacaggcatgggccaacacacctggctatttttttttttttttttttttttggagagatggggtctctctgttacccaggctcctaacaccattttaaaaagataacaatatttgacaatatatcattaactgccacatgaaaggccttgataaatgctatggtcagaaggaaaagacacattttagctagaatgatcagaaaatcagagccaagatgggcatggggatagagtgggaatgttagctatgccagtaataagaaagaatacctgcataaactggaaataggaaagggaggagaaaggggcaggataaaaggctggcaagcaaaggtaaattccaaggatagtgattaggctaatctcagaaaaacataagaagagaatt

SEQ ID NO: 5743 - DNA, 104 bp, Homo sapiens; identical to SEQ ID NO: 2952

SEQ ID NO: 5744 - DNA, 577 bp, Homo sapiens
tttttttttttttttttttttttagaagagacggggtttcgtcatgttggccaggctggtttcgaactcctgacctcaggtgttccacctgctttggcctcccaaagtgttgggattacaggcgtgagccactgtgcccagccatgcaattcttaaaattacattcttaaaaaaaaaaaattgcattttggctacactttggacatatatggttctctgcatacaggtctcacaggtttctgatgcaaactaaaaagcagtacaaatctggtaaaatctgattgtctgaagcctctcaatctttctgctccttttgggaggtgggggtagaacaggggaataggatttgaagcaggagcgtcatcagtatggaacaatgcagtataaagcatgaaagctgagcaaacagtcagatctggacaagcttctttctctttgttgccaagtttggagtaaaaaatgcctcatcatgtcatggttgtgaagattggactaaatcatgtatgtaagctgcctaacaccgtgcctgatacatagtatatgttcaagaaaagtgaggtattttcattccccttct

SEQ ID NO: 5745 - DNA, 495 bp, Homo sapiens
ttttttttttttttttcttttttggaagccaaatagagttctcctgcataaatatctcacctaaatatttctcttacaaagaatttttcctgttaaaggtgtttgagagacatttaactagtgatattgtaattggcctgtgctcaggggaaacattgatcaataagtcactatgaaaatgttgccatggttttaatggcaaagcacccctgaaaacaagtagctatgtgcctctataacagaatacatggtcctgacgccttattgctttttggagataaacaaaatcattttgttcaaacataagaccaacagtgaataaatataataaacaggttagaatattagctttggggggacgggggatagcggggaaatgaagaactgaaacatgcatatgcacacacatgcatgcatgcacacaccttttttacaccttcaatgtacaacagagtagcttgggtttttacatccctggctaaactacagctgatg

SEQ ID NO: 5746 - DNA, 281 bp, Homo sapiens
ttttttttttttttttttttttactttggctactggggcctcaaggttaggttaatgttaagttgtagttttccttagtcaggagttaagacaccaactgtcttaccctcccattagcttggcacatattcttttactcttgttttaatgttctttcacttaagctataaggtttgtttgtgcttttgtcagtaggaacggcattattaaatattactgagtcacatcagagaaccattaatctagttgtaaagaacatggtgccaaggcggtcattttgt

SEQ ID NO: 5747 - DNA, 514 bp, Homo sapiens
tttttttttttttttttttttttgggagacaaaaaaaaattttattgccataaattaatccagtaggtatatttgagaaagcacgcatcagttggttagggcaataagcgcctctaccacgttgcccatgtgttcccgcaaactgcgttctgctgctgctcgagatatctccatctcagtcattattagctccagatcttccttcttgatagtgacttttgccagttctttctcccgctcctgtttggctttctgctcccgggaccttctgtctccaatcacagacatggccgtctccagattggaactctggatctccttctcctctgcatagtcggtgacccgctccaagtccgccgcaccgctgtcatgtttccgtggcttctccggaggccgctctggtccactggtctcagtctccaactccagctccacatccccctcggtcgccatatctatttcaccacgccgccgcataagccccacctcacgccgacttccggcaactgacaca

SEQ ID NO: 5748 - DNA, 493 bp, Homo sapiens
tgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagaaaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagatt

SEQ ID NO: 5749 - DNA, 465 bp, Homo sapiens
tttttttttttttttttttcttttttttataagaaatgacactacagaactgcaatactggtccaacactcttgtctttactcttcttttaaagcaagaaacagaatgcgagtaatcagaaagcactagcaggcatcagttaatccaagatactagctcttagttccaaaagcacttgcaaagaaaaccttttggggggaaggggtggagagggatggaagcactccataataactggaatccctcgagtgtgtatgccaagtctcatgaggctattttttgaatttatcctttacttggtcatggtttttttccctcaaatacaatttttcttttgactttttttcctcaaagtataaaaagtatgaaatataaacaagctcttgcactgcacacttagaagtgtacaattcaagcattatagagctatctacacactgataaatcccatcgaatcttggataa

SEQ ID NO: 5750 - DNA, 334 bp, Homo sapiens
ttttttttttttttttttttttttttcgcactgttgtttcacattctcacagccctcagcacaggtcacgtcccagcccagctctgggactttggttcagggctcaaagcctctggtctgggctgatcgaaaacctcctttgaccctgtggcagtaggcggaccttggctcttctcgtccttacccagagctcagggcagtgccccgtgcagtcgccccacttccacgaaggcctccacgcagcggtcaatgtcttcctcgctatgcaccgctgagatctgtacccggatccgggccttgcccttggggaccacggggtagctgaacccgatga

SEQ ID NO: 5751 - DNA, 460 bp, Homo sapiens
tttttttttttttttttttttcaagactattttcctgcgcctcatctgccctcagagagaatgatccccacagtgatgaggggtcagcactctgaaagccagttgacgccagacaagctgctggaacagctggggcacagctccgcctctcctccagcccctcggtcccatgaggccaaacaatgaggacagaggggctgaggggtgtgtccagggcccagtcccacctcagcaggaaggtggcgtcagcactcgcagtcccagcctcacgccgcatcgcagtcccaggggatcttcacacagggagggtgagctggttaagaaggcgggtgatcctccccccggatgcttcgatacttagccatgtcttccggaaatactttagaaagttcttgaatcaacaggcttttaaatttcttcatggtgtcgatcttgcctttaacttgctcatttttagcta

SEQ ID NO: 5752 - DNA, 466 bp, Homo sapiens
ttttttttttttttttttttttaaacatttttaccttaactatgaggcaggaaggataatcttcagggaaatgtatcaagttccaagtagttaaagtgattcctttaaatcactattattgggatcctaatcagaaaaattaattttctgctagatatgataaggtggtgcttttagagttggaaaattttcaaaaattcttctaatcttgggccagtaaagatacattttccttacaaactaaatgcatacactttgggagagaatcattggcagaagccacttacctccagctccttagaaggaattccttgatctagcaaaccccgcaggactcgaatgactgattttaagttggcacccgtgtatttaccagagggaagcactttgacgacagggagtacagcgagctcatcgtttgtcagaaaggaatgatctaataggaagacagcaatttaaaaacagt

SEQ ID NO: 5753 - DNA, 295 bp, Homo sapiens
tttttttttttctttttttttttttttgtagagacggggtttcaccacattggccaggatggtctccatctcttgacctcacgatctgcccaccttggcctcccaaagtgcctgggattataggcgtgagccactgcacctggcctcagtgaagtttttccaaacctcctgattagaccaattccctgttatatttatttattcattcctctaacaaacatctatggagcacctaacgtgtgtcagatactgttcttgctactggagacagagcaatgaccacaatcaaagcttt

SEQ ID NO: 5754 - DNA, 524 bp, Homo sapiens
ttgtttaatcacattttaacataaatcatctattccggattacaattttatgtggtccactatcagccccattttatgagggaacccaggattggagacgttaaatgccttgcctaacgtcacttagcaagtaagtcacaaagacagggaatggtggtctgactctagaatctcttatccctgtgtcatgctgggaactgtgagtattctgtccccatgacacaggaggccctgacaagacaattttagctcatgtgactgggactttacagcttaaagaatgaatctttaacacatgctagaattaacatatttgatattagttatccttcacagctgtcacactcttggaaggccattcggtccaataaagctacacaaaacatttctggcataagccatgttaaaaaataatcttatctcagtacatacgccacacttaaaacacacatacacagagacttcaacactcaatttactcatcaaacttagttccattagacacctggtctttaaaaaagcct

SEQ ID NO: 5755 - DNA, 632 bp, Homo sapiens
aggagccaagaggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctgctttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggg

SEQ ID NO: 5756 - DNA, 634 bp, Homo sapiens
tatccaaagtgtgtacatcagtaagatcataagcagtgatcgagatctcttggctgtggtgttctatggtaccgagaaagacaaaaattcagtgaattttaagaatatttacgtcttacaggagctggataatccaggtgcaaaacgaattctagagcttgaccagtttaaggggcagcagggacaaaaacgtttccaagacatgatgggccacggatctgaccactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggaggccaggaagcgagcactcagcaggttaaagctgaagctcaacaaagatatagtgatctctgtgggcatttataatctggtc

SEQ ID NO: 5757 - DNA, 455 bp, Homo sapiens
gaaagtcttcagttactatttggcctttcctagatccaaacacggggactgcaaaaaaaggctgtgtgcatccgctgtctactccactgcctcctttgcaaaggcggatttccctgactgaaaaccatgttgcaggcccacagctgcctacagaaccgtcccaaaatatggcaaagaaacctattctgagcggtagggtctcaccatgttgcccaggctggtcttgaactcctggactcatcctaaagtgctggcctctcattccctgtctgtgcacacctaacggcaagggccagcctgtttcctcccggtcacctccaaatcttgctgcttttaattcaactcaaaggcctacccagggttgagttctcacccacctgtcccgccctgccttgttacctggaagcacagccttggggactgagcaggccctcactgtcactttaaaaagggaa

SEQ ID NO: 5758 - DNA, 596 bp, Homo sapiens; identical to SEQ ID NO: 1381

SEQ ID NO: 5759 - DNA, 549 bp, Homo sapiens
  misc_feature 354: n = A,T,C or G
aagctcatcatcctggaacactattctcaggcgagcgagtgggcggctaaatacatcaggaaccgtatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgtngcctttgaagagaagatcaaggctgcaggtgggatcgagctatttgttagaggcatcggccctgatggacacattgccttcaacgagccaggctccagtctggtgtccaggacccgtgtgaagacgcttgccatggataccatcctggccaatgctaggttcttcgatggagaactcaccgaggtgcccaccatg

SEQ ID NO: 5760 - DNA, 474 bp, Homo sapiens; identical to SEQ ID NO: 1385

SEQ ID NO: 5761 - DNA, 484 bp, Homo sapiens
atcacacagatggagtagtagcttgtgctgctggactaataggggacttatgtacagcatttgggaaggatgtactgaaattagtagaagctaggccaatgatctatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaa

SEQ ID NO: 5762 - DNA, 492 bp, Homo sapiens
gtcacctttctgctgtataatacagcgtaaccctacttgagacatttccatttaaattgctctgttccacatgtgttcatcctgtccttgctgtaactgtgtaggtgggtgacaacattttcgaactgtatatttgtcacctctgttagtctatctctaagaacacagccaataagacatcacttgacaagccattaccttattgaccaagactattttgtgaatcaaatgcaatgtgacttgaaaatcaaatcgtttcaatggtcatttaagttgttaattttaaaaaatggtcatttcagcttgatgcataagagcgttctttgcaggaacttcatttttgactacaaaggctttgaattttattttgctgcttgcagtaattttgttttctttttcttccagggtatatgagaaaatattgactcctatctggccttcatcaactgacctcgaaaagcctcatgagatgctttttcttaatgtgatttt

SEQ ID NO: 5763 - DNA, 537 bp, Homo sapiens
aaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgag

SEQ ID NO: 5764 - DNA, 532 bp, Homo sapiens
tttccctgttagacatgggcactccacagaaggatgttattatcaagtcagatgcaccggacactttgttattggagaaacatgcagattatatcgcatcccatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcaccttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatc

SEQ ID NO: 5765 - DNA, 637 bp, Homo sapiens
cggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctctgcggacagtctcattagcaacatcctccttcgggtctgggatgccttcctgcacgaggggacgaaggtggtgtttcgctatgccttggccattttcaagtacaacgagaaggagatcttgaggctacagaatggcctggaaatctaccagtacctgcgcttcttcaccaagaccatctccaacagccgctgatgaacatcgccttcaatgacatgaa

SEQ ID NO: 5766 - DNA, 522 bp, Homo sapiens
tccctggctgacagaggaaccctggaaaattacttcgcgcttgatggagaaggacaaggccagagattgcccgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagc

SEQ ID NO: 5767 - DNA, 344 bp, Homo sapiens
ctgtatgtaccgaggtaaattattccatccagttgcatctctttttatcttcctctgttaaataatagtatactccacagagagctcctgtgagattaaatgagctatgcacgtgatgttattctgttacctaaaatggagaccagtgtttgtctaatggagtgtagtggttacagacacaggctctagtgctaggctatgtgttcaaatcttaattcagttattttttagctgtctggccctttcataagttattttgccatactgagccttggttccccatctgagaagttgaaatttaaaaaaatccctcttactgtgtcatcataaggactaactaattg

SEQ ID NO: 5768 - DNA, 647 bp, Homo sapiens
ccttctgctctttacattccttaagaagaaccgaaagaagaagcttatggtcttcttttcatcttgtatgtctgtgaaataccaccatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgttacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatg

SEQ ID NO: 5769 - DNA, 488 bp, Homo sapiens
cagaagagaagaatgtattgttgaactcccttcagaaagaagataagagcccagagacagggacagcagggggcagtagcacagcaagttattcagcaggagggggcttataggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccaactacttacagtgtagctctgttggctcctaaatgtgagcaggacttgactataaagaatgattatagtggcaaatggactgatcaagcatctgctgagaaa

SEQ ID NO: 5770 - DNA, 658 bp, Homo sapiens; identical to SEQ ID NO: 1393

SEQ ID NO: 5771 - DNA, 630 bp, Homo sapiens
aacatagtgaaaccccatctctactaaaaatacaaaaatcagccgggcatggtggcgcacacctgtaatcccagctactctggtggctgaggcatgaaaattgcttgaaccagggaggcggagattacagtgagctgagatcctgctactgcactccagcctgggtgatagagtgagagactgtctcaaaaccaaaccaaaacaaaacattgtatataaataaatgttatagcttgttatatggcttttaaaatgtaaatatgtatcaggtagtttgtagctataacaagaagtgatatctctaaaatacgcactgttaatttgtagtagaatccattaaatgtctaaatttctttttatttaaaataatgcagaatttggctggggatggtggctcacacttgtaatcccaacactttgggaggccatggcggatggatagcttgagctcagaagttcaagacaagcctggcaacatggcaaaaccacgtctctaaaaagaatagaaagaaattagccgagtgggtggcacacacttgtagtctcagctcctcaggaggctgaggtgggagcatagcttgagcccaggaggcagaggtttcagtgagctgagatcatgccactgcactc

SEQ ID NO: 5772 - DNA, 459 bp, Homo sapiens
gcggctaccttactagctgttcggggagccgggccagcaccggcttgggggccggaggcgttcactccagactgggaaagccgagaagtctccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatg

SEQ ID NO: 5773 - DNA, 561 bp, Homo sapiens; identical to SEQ ID NO: 1395

SEQ ID NO: 5774 - DNA, 556 bp, Homo sapiens; identical to SEQ ID NO: 1396

SEQ ID NO: 5775 - DNA, 587 bp, Homo sapiens
ctggcgggcgcggggaaaaggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgttgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtcagtcattgatataatcaatggagaggccacaatgctgtttgctgagctgacctacactctg

SEQ ID NO: 5776 - DNA, 614 bp, Homo sapiens
ttgggagctggaactgaatgggacagaagcgaattagtgcggaaagttgccggggaaaaaacacggtcactttcaacattaacaacagcatcccaccaacatttgatggtgagggggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatga

SEQ ID NO: 5777 - DNA, 589 bp, Homo sapiens
  misc_feature 490: n = A,T,C or G
gcttaaggacaccaggcaggcgcgacagccttcagcctctccctctgcggttttggccggttcctttaacttgccttcatctggggctgtttggtatttccacgtgccttgggcccgcccactgcagcctccatcttggaagcggccgccggcgcctagaactgtatttcagaaaaaagaaattacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtaggatctagccttcagctgtcctgccctttcccacacgagagccaggtagacagcaggggccactcttgcaggtgggcctcagcagatattgtccttcagctggtttgcatgtgttccccttgngttggaggaggagtcccctgtgtatggccagttaattgcagagcagtgggcttcagcactgaactgaggtagactgacattcttctctggaacttgtgc

SEQ ID NO: 5778 - DNA, 442 bp, Homo sapiens
atcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagc

SEQ ID NO: 5779 - DNA, 530 bp, Homo sapiens; identical to SEQ ID NO: 1397

SEQ ID NO: 5780 - DNA, 628 bp, Homo sapiens
ggtcgctggggcgcgtctttcccacccgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagccatttctgtcttggcctcgccactgacgtcccttctttcctgtggggacaggatggacagattcctggtgaaaggggctctagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaagctgagcagatgag

SEQ ID NO: 5781 - DNA, 559 bp, Homo sapiens
tacggccgggtatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagattctgaacacaaactcgagacgagttcaggaagagtactgggaagattagaggaaagggaagtggaggcttaaaccttggtaatttctttgcaagccgtaagggccacagtcgaaaagggtttgaccggcttagcactgagggcagtgaccaagagaaagaggatgatggaagtgaatcagaagaggagtattcagca

SEQ ID NO: 5782 - DNA, 605 bp, Homo sapiens
ctgccaagttagcaatgaatgtttcccatttcttcttagtttatggactttccataaactcaggatggcagtttggttggttggagaaggatatggtgatggcgggagttacaatacattacttataggggaagataggcttttgaaaggttaaagcttaaatgtgagagtggaaaagggatgaatgaatgaacatgatgaggtgagagggaagaggtaaagggaaaaggagaacaagaaactcttctctgcgtggcacctgggatgaatggtttctggggacatccctgatggcagttttgtggagaggtgcaaagctttatgtgttaagaaatgagctgtaggctcagtgcagtggctcacgcctgtaatcccagcactttgggaggccgaggtgggcggatcatgaggtaaggagttcgagagcagcctggccaacatggtgaaaccgtgtctctccaaaaaatagaaaaaacatccctgtatggtggtgagcacctgtagtcccagttactcaggaggctgaggcatgagaatcgcttaaacctcggaggcggaggctgcaatgagctgagatggtgccactgcactccagcctgggtgac

SEQ ID NO: 5783 - DNA, 552 bp, Homo sapiens
aggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaag

SEQ ID NO: 5784 - DNA, 576 bp, Homo sapiens
caacaagttccattaatgcttaagctaataatgtaggttgggttttctgttactttcaactgcaggaggcttacctgttacaacagactctctcaattcaatttcacccaagttaagaatcaattaggactcaacaacaaaaagacaaatgacccaatttaaaatgagcaaatgttatgaatagacatttccccaaagaaggtgtacaagtagccaataaactcttgaaaagatgttcaacgtcattaatcattaagaaaatgcaaatcaaaaccacaatgagatataactttacaccccctaggatggctgtaataaaaaatatgaacaacaagtgttggcaaggatatggagaaattagaacccttgtaccttgctggtaggaatgtaggtggtacagccactttggaaaacagtctggcaggtcctcaaatgattaaacatagagttaccagctattctactcctaggtatatacccccaaaacatggaaatatatggccgcaaaaagttttgtacaagaatgctcatagtacttgtattcataacagcccaaaatggaaaacaactcaaatg

SEQ ID NO: 5785 - DNA, 99 bp, Homo sapiens
ataaatcacataggcagcctgctaaatggctatgataagcccttcagtggaaatagagatttagctgtgataatactgctaacttattgcacctgacca

SEQ ID NO: 5786 - DNA, 547 bp, Homo sapiens
cggccggggctggcaagaagaattttaaagcttaaaataggtggtaaatttgaagtatgagtgtgttccgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttgaaacagctgaaaattgggacaacatactttacgcaatgaacagtagttaaataggaaataaactagtt

SEQ ID NO: 5787 - DNA, 436 bp, Homo sapiens
cagggtggcatgcacctgtagtcccagttactcaggaggctcagatgacaggatctcttgaacgcatgcggtggtgcctgcagtgtgccatgatcatgccactgtactccaacctgggcaacagagcaagaccctatctcagaaaaaaaaaaaaaggcatggattttttagcctttttagttttaaaaaatcctttttatgaccttttttaatttagcctttttttaaaaatttggcccaaatattggctaatcacttttaaaaattaatttttagcctattccccccaaaaaacctttaaaaataaaaacctggagtttttcgggaaattctgttttttcgggggcctaatattaaaaatccctttttttgttgggatcccaaagggttccccattttataataacctcacttgggggggaaatttgggaaaaaa

SEQ ID NO: 5788 - DNA, 325 bp, Homo sapiens
tacggccgggctaatttttgcatttttaatagagaggggtttcaccatgttggccaggctggtctcgaactcctgacctcaggtgattcaacttccttggcctcccaaagtgctgggattacaggcatgagtcaccgcacccagccaagactgagctcttttaatgcccatataccgagggtagaaatctacaaaacatatgacctgcaaactgaatgatcaggaaaggatcctaaccaccagaatgggcaggcagagttgtaaaaaaacaggggatgagagtttccacccactacatgcgtctctgacatttctgcaggcaccc

SEQ ID NO: 5789 - DNA, 488 bp, Homo sapiens
tacggccgggcgtggtggctcacgcctgtaatcccagcactttgggaggctgaggcaggtggatcacctgaggtcaggagttcgagaccaacctggtcaacatggcgagaccccatctgcactaaaaatacaaaaattagccgggtgtggtggcttatgcctgtaattccagctactccagaggctgaggcacgagaattgcttgaaccccgggaggcggaggctgcagtggcaaaatgttgattttctaattctctcattctttttgtacttttttatctggaattcttctatggagacaaagtattctccattaattacttggcgaccttggggttctgcctggggacaggcgtggtggctcacgcctgtaatcctagcactttgggaggctgaggcaggcagatcacgaagtcaggagatcgagaccatcctgaccaacatggtgaaaccctgtctctactaaaatacaaaaaaaaaagtacccg

SEQ ID NO: 5790 - DNA, 544 bp, Homo sapiens
ctaattttgtatttttagtagagacggggtttctccatgttggtcaggctggtctcaaactcatgacctgaggtgatctgccagcctcagcctctccaagtgctggaattacaggtgtgagccaccacacccagccaggaaaaagctttaaagtggctattatactgttctctgagaggatgaactctctgaaagaagtaaaaagacagaaaatctcaacagaggaacaaaattaaaaaactacacaaatgacaaaaagcacattagaagacactcagtgtcattagtcattaggaaatgcaaatccaaaccaaagaagtgaaagatctccacaatgaaaaccataaaacattgatgaaagaaactggagaatgtcaaaataatggaaagataactccacggtcatggtttgaatcaatattgtttatctccttcaagaacaaaaaaagaaaaatgaaaaaagaatcaatgttgttaaaatgtccacaccaaatgaagaaatctatagattcaccaaaatccctataaaaatatcaataacatt

SEQ ID NO: 5791 - DNA, 540 bp, Homo sapiens
  misc_feature 438: n = A,T,C or G
agggaagagagggcccctcctgcagggcctcacctgggccacaggaggacactgcttttcctctgaggagtcaggagctgtggatggtgctggacagaagaaggacagggcctggctcagcgtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccanggctgctaggaaaaggaatgggcagacacaggtgtatgccaatgtttctgaaatgggtataatttcgtcctctccttcggaacactggctgtctctgaagac

SEQ ID NO: 5792 - DNA, 367 bp, Homo sapiens; identical to SEQ ID NO: 1400

SEQ ID NO: 5793 - DNA, 214 bp, Homo sapiens
  misc_feature 27, 28, 31, 34, 41, 42, 44, 46, 49, 57, 60, 63, 73, 77, 80,82, 87, 89, 93, 96, 99, 103, 107, 114, 118, 121, 122, 125,129, 136, 143, 146, 149, 152, 156, 166, 174, 175, 182, 190,193, 199, 207: n = A,T,C or G
ctttctctttttttctttttttttttnnagncgnagtttcnntntngtngcccaggntgnagngcaggggccnaatnttngntaacnanaacntcngcntccnaggntaaagcnattntcnngcntaancctcccnagaagtnggnatnacnggcntatgccaccntgcccggnngattttngaattttnagnaaaaanggggtttntgcatgt

SEQ ID NO: 5794 - DNA, 605 bp, Homo sapiens; identical to SEQ ID NO: 1401

SEQ ID NO: 5795 - DNA, 596 bp, Homo sapiens
ttttttttttttttttttttttttactggctagaaatttttattatttgcgaggcagtaagtgctcttgagagcaggcacagtgctgggaacactaggccccttcgggacaaaccagggccttaaggaaaggggcttcggctttggcttgagggaaggcacataactgggacaggccctggccgggagtattcagaagccaagtgggttgctggtgaccacaccaccccgctccaccaaggccttggagatgcttttgaagttgcggtagagctcttgctgccaggggtcagactgcagggcggccatgccccctcggatccgagctgcagcctcgatacaccaggtgtcacagagcattttctcatgctgggccgtggggtgccctcactcagggatcttgaggccctcgagagaaccaccaccatggcatagaggtcgatggccccgtctgccagccgctgcagcagaaactgttcattgacaatccccttcttgtgttttatcagcttggcctccaccacagtggcaaactgctccagagcccgtactgccagctcgccactccgactcaactccgggtggacaagtccgctg

SEQ ID NO: 5796 - DNA, 514 bp, Homo sapiens; identical to SEQ ID NO: 1404

SEQ ID NO: 5797 - DNA, 385 bp, Homo sapiens
tttttttttttttttttttttttaatagagatgaggttttaccatgttggcaaggttagtctcaaactcctgacctcaggtgatctaccagcctcagcctcccaaagtgctgggattacaggcatgagccaccacgcccggccagaatgacaattcttaaacctacaatgacaacaccctatcccatgatgtctccattttcttgcacgggaactacaatgagaacagtgaccatctctatgtcctaccaagaaatagtcctgttcagtggacagcattatcagccttataaaaatatgaagctggaaagagacaccagtttttagctaccaaaaagtgttcagttttggttagagaacacctccaaaaaccagaaaaaaattag

SEQ ID NO: 5798 - DNA, 159 bp, Homo sapiens
ttttttttttttttttttttttttttggcgaaattaataataatatgaccactttaagagatacaatctatccctcaataaattggactctctgctttgtcctaaagagaatttctccgaaagtattacataaaaagttactaagtcaaaattcaagcc

SEQ ID NO: 5799 - DNA, 388 bp, Homo sapiens
aggggaggaaaggctgggccccgagtacaacggatgccttgggtgctgcctccgaagagactctgccgcagcttttcttctttttcctcatgccccgggaagacagtcattcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatg

SEQ ID NO: 5800 - DNA, 467 bp, Homo sapiens
tttttttttttttttttttttttttaggggtacaatttttttttttttttaaagatacagggtcttactctgtcataacagcctcaacttcccaggctcaagctatcctcccacctcagcctcccaagcagctgggactacaggtccatgccaccacgcccagtcaatactttttttttttttgtagagatggggtctccctgtatggcccaggctgctctcaaattcctgggttcaagcaatcctcctaccttggcctctcaaagtgctgcgattacaggggtgagccatcacacccatccttaccatttattaattggactttgggcctaataaaaaacaaacaaattgtaaaggtatatcagacctgggcaagattactgcatgctcagtgtgtagcaaactctctgatttaggtcaggtacaagtttatggtggaaatagtaaaaactaattcatttatctga

SEQ ID NO: 5801 - DNA, 495 bp, Homo sapiens
aagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtac

SEQ ID NO: 5802 - DNA, 64 bp, Homo sapiens
tgccttcataggttatatgccaagatagtatttgataagtcaatgacatttggatgttttcttc

SEQ ID NO: 5803 - DNA, 411 bp, Homo sapiens
tttttttttttttttttttttttacgacaaagtcttgctctatcacccaggctggagtgcagtggcgcaatctcggctcactgctccagcctgggcaacaagagtgaaactccgtctcaaaaacaaacaaaaacaaacaaacaaacaacaccaccaccacctcataattacaagattaagtacctttgaacatttgtttctgaacctaccacacgcaactgtcactttgcaggtgcttaataattgtgagcgaacattcaacaaacctcatttcataaacttccctactgaaatatagtggtcataggagaccagcagtttagctcatggcttctggtccttgctttgtattggaatactgcttctatctactgactcgtttaccctgggcttcagttccttctttgggct

SEQ ID NO: 5804 - DNA, 535 bp, Homo sapiens
agctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggttatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaac

SEQ ID NO: 5805 - DNA, 555 bp, Homo sapiens
tttttttttttttttttttttttagacgaaactaccattaatgtgcttggttaattacgggcagagacgctgggagagggcctcggaccacaggagccagtatatgtgttgagacagaatggggcgggaggacctacacatgtctacagccatgcacatgctccttctccacagcacacccagccaagcatccacctagaaccccccactccacccactggggaagccaaaccctttaccccagtctgggccatgccaaaaggtccagggttcatgcccaggaagagtacttccttggggccctggcagtagcgagtcacgtagttgcgatgtggctcccatgcatactccacgggattgtagatgatgcccacaggctccgaaaactgcagctggctcagctcagcattgagccgaagctcctcctccaggaagctctcagccaagcttccagggcagggctggggctccatgggggcacctgcaggctcatggatggaccccagcaggaaagcctggggcatatgtccatgccgctgtcacatgacaggcact

SEQ ID NO: 5806 - DNA, 585 bp, Homo sapiens
aagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccactcgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggagtttactgatctggtccctgagaaacatattgtgatgaagtggaggtttaaatcttggccagagggacactttgccaccatcaccctgaccttcatcgacaagaacggagagactgagctgtgcatggaaggtcgaggcatccctgctcctg

SEQ ID NO: 5807 - DNA, 483 bp, Homo sapiens
cactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctacccctta

SEQ ID NO: 5808 - DNA, 556 bp, Homo sapiens; identical to SEQ ID NO: 2587

SEQ ID NO: 5809 - DNA, 617 bp, Homo sapiens
aagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggtacagtgagatccagcagcttgaacgcagtattcgtgagctgcacgacatattcacttttctggctaccgaagtggagatgcagggggagatgatcaatcggattgagaagaacatcctgagctcagcagactacgtggaacgtgggcaggagcacgtcaagacggccctggagaaccagaagaaggcgaggaagaagaaagtcttgattgccatctgtgtgtccatcaccgtcgt

SEQ ID NO: 5810 - DNA, 627 bp, Homo sapiens; identical to SEQ ID NO: 1411

SEQ ID NO: 5811 - DNA, 564 bp, Homo sapiens
agtggagtgaggggtaacaagataacgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgattt

SEQ ID NO: 5812 - DNA, 539 bp, Homo sapiens
aatctaactcagcggaattgtatccgtacaatacaagcacatgaaggctttgtacgaggaatatgtactcgcttttgtgggacttcttttttcactgttggtgatgacaaaactgtgaagcagtggaaaatggtatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgactgtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattacaacttatatacttttgatatgcgtgcactggacactc

SEQ ID NO: 5813 - DNA, 486 bp, Homo sapiens
aaccatacatatgatactttggcctctcttttttagtgaaattatagcaagtctgcagggcatggtggctcatgcctgtaatcccagaaatttaagaggccaaggtaggaggatcgttggagcccaggagttcgagaccatcctgggcatgcaaaaaatttaagttgggatggtggcacccatttgtagtcccagctacctgggaggctgaggctagaggattgcttgagcctggagattgaagctgcaatgagctgtgatcgtgctcattgtggtgtgggagacagcacaagcctgtttttaaaaaaaaaaaaagccatatttatttatatatggcaaatcctcaaattgggaatgttatcaatactctaatacttctgactacctttattttaaaaatcacctgataatattaattagtattaccaatgttggtatttggggattattaaagggaggaagagttttataagttttattatcaat

SEQ ID NO: 5814 - DNA, 564 bp, Homo sapiens
gctccttcacctaccaaacgcaaagaccgctcagatgagaagtccaaggatcgctcaaaagatagaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaat

SEQ ID NO: 5815 - DNA, 252 bp, Homo sapiens; identical to SEQ ID NO: 1413

SEQ ID NO: 5816 - DNA, 396 bp, Homo sapiens; identical to SEQ ID NO: 1414

SEQ ID NO: 5817 - DNA, 411 bp, Homo sapiens
tacggccgggatgaagatgatgctcagcagcaggggccacaggtccttgttgcccatgatggagtccaggtcgaacacctgggcgatgaggatgccgacgacgatgcccagctggtgcagggtgcccagggccccacgaagggctgtgggtgacacttcacccacatacatgggcacgaagcctgtggtcaggccgcagtacacaccgatgatgaagcggcccaggatcagcatctcaaaggacttgcccagtttcgagaagcccatgagcacggcggacacgaaggccggcaggttcatcatcagcattgaattccgcctggggacggggtcacaggtcaggccagtgcccacattccttgggctccgaggggctgggtcagaggtaataccctggaacaggcagataag

SEQ ID NO: 5818 - DNA, 111 bp, Homo sapiens
tgagtatcttacagcttgcctttttaatgttagtcacaatgtttttgtggtttgaagtttagtttaatgttggtgcagtgacgggaaatacacattatgctaatgttgatg

SEQ ID NO: 5819 - DNA, 499 bp, Homo sapiens
ggcgtcgggtacgcgcaccgttgcatcttcttcctttcgcggggtcctccgtagttctggcacgagccaggcgtactgacaggtggaccagcggactggtggagatggcgacgctctctctgaccgtgagttcaggagaccctccgctaggagctttgctggcagtagaacacgtgaaagacgatggcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgc

SEQ ID NO: 5820 - DNA, 588 bp, Homo sapiens
ctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtacgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggc

SEQ ID NO: 5821 - DNA, 329 bp, Homo sapiens
tatatatacttgtttagttaattaaacatatattcaacatttaaataactaagtggtacggaaataatgatgaaggtcacagtgtatattggttaaaaataaaataaatacgtttgtaggccaatttatggtacagcgctgtaacagaaccataaccgtgctgtgagagtactgaaaagggactgatgcagttgacttaaggaaggtcttagatatggtgacatttgagctagggtttgaaggatgaaaagattacagaggttgaaggcattgcagagaacaacatgtgtaaagcatatagtgtacactgggagattaggggacaattt

SEQ ID NO: 5822 - DNA, 589 bp, Homo sapiens; identical to SEQ ID NO: 1420

SEQ ID NO: 5823 - DNA, 525 bp, Homo sapiens
atgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaag

SEQ ID NO: 5824 - DNA, 641 bp, Homo sapiens
tacggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccatctagcagtccaggtccctcaaccttcaccaaacactac

SEQ ID NO: 5825 - DNA, 637 bp, Homo sapiens
agaaccgcctggggacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggaggggctcaacaaggccatgaggggggcaggaacgaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgcctcttctaccccatccctcacagcctc

SEQ ID NO: 5826 - DNA, 559 bp, Homo sapiens
ccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagt

SEQ ID NO: 5827 - DNA, 599 bp, Homo sapiens
  misc_feature 506: n = A,T,C or G
acccatccttaatacgatgatttttctgtcgtgtgagaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttnaggctgggggtgtggggcctgccggcgcattctccacgattgagcgcacaggcctgaagtctggacaacccgcagaaccgaagctccgagcag

SEQ ID NO: 5828 - DNA, 63 bp, Homo sapiens
gagggcaacatctttgtcaccaccacaggctgtattgacatcatccttggccggcactttgag

SEQ ID NO: 5829 - DNA, 601 bp, Homo sapiens
aatgcaggagtccagtacctctacttcagcaattacctacagattgatgaggaagaatatggtggcacgtgggagctcacgaaggaagggtttgtgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgttagaggttttaaactatcaatggcatttcaagtcttctgaaacgcatggctgtatgtgccgtggtccatagcacagtacatgcagcat

SEQ ID NO: 5830 - DNA, 567 bp, Homo sapiens
gtgtaggcaaagaattcatgactaaaacctcaaaagcacaggcaacaagaacaaaaatagacaaatggaacataattgaactaaatagcttctgtaccacaaaaataaataaataatcaagtgaacaggcaacctattcactgggagaaacaaaaaccctgcagaatgggagaatatatttgcaaactatgcgtctgacaatggaccaatgtccagaatttacaaggaactcgaatagcctttctgactagtgtaaggtggtatctcattgcagttttcatgtgcatttttctgatgattaatgattttggacattgtttatatacctgttggccatttgtatgtcttcttttgagaaatgtttattcaggtcctttgcttatttttaattgtattatttattttcttgctgctgagcttttgagttccttatatattttagatacaaacccattatcagatgtatgatttacacatatttttataggataaaatatagaaaacaaattactaacgattatttaacctttttagataaatatatgcatctataaatatgttatttga

SEQ ID NO: 5831 - DNA, 578 bp, Homo sapiens; identical to SEQ ID NO: 1427

SEQ ID NO: 5832 - DNA, 586 bp, Homo sapiens
ggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccat

SEQ ID NO: 5833 - DNA, 627 bp, Homo sapiens
aggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcggaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtatgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccc

SEQ ID NO: 5834 - DNA, 513 bp, Homo sapiens
tagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagcccatcagaaaaaaattctccatgttgacaaccatattggtatctcaattgcggggcttattgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacat

SEQ ID NO: 5835 - DNA, 584 bp, Homo sapiens
cccccgtcagcaggctggggtctgcccaccagggcctcccccgtctgcctttgagggtgcctgccatgccctgggggatcctggcatctttactggactggaagcaggagacagaacagtgtctgtcccggggtgacctcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccggttgagaatctgccccaga

SEQ ID NO: 5836 - DNA, 604 bp, Homo sapiens
accacggcttcaggtgagcgccgatggccggctgatcataagggaggaggcagacggcaacaagatggaggaagaggagggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccagcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctc

SEQ ID NO: 5837 - DNA, 457 bp, Homo sapiens
ttctgtgggtggtatcattgcagggtatgtaatggtgatactgaataatcaatgaaaggttaaattaggagagtgtctaatgttttttaagaatgatttctgatcctcaagatttttgttttttaatttgatactctaaaggataagcttcagtaacctggaaaattgaactatatgttgtttaaatttttctttttggtgtaagcaagtgtacagtaggatgataaggtgttcatttctcgcctgccccccactgcctacactgaaacaaatttgctatggaagtaattttagggaagtactttagaaattgtactggtgctgattaagatatgcatcattcagttgtactgcagactctgagatcactaaatgccaatttaaatatatttaatctttctttaattaaaaggaatttgtacattaattccacccccttacacccatgacatacccc

SEQ ID NO: 5838 - DNA, 416 bp, Homo sapiens
tggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaatggtacccccgacagaaaatatgttacgctaagagaaagttagcaggtgccaatccagcagtcattacttgcgatgagctactcctgggtcatg

SEQ ID NO: 5839 - DNA, 551 bp, Homo sapiens
aaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaa

SEQ ID NO: 5840 - DNA, 634 bp, Homo sapiens; identical to SEQ ID NO: 1433

SEQ ID NO: 5841 - DNA, 347 bp, Homo sapiens
ggcttggtggtgcaagcctgtagtcccagctactcgggaggctgaggcagaattgcttgaacctgggagagggaggatgcagtgagcccagatcccaccattgcactccagcctggcgaaagagcaagactccatctcaaaaaaaaaataaataattttaaactattactcaaaactccagggttggagagcttattttggtaaatatactgaaaatgaagggggctaaagtaaggagaggaaagcccattaaaaataatccccagataaattgtgctaagctaaagaaaatatttattattctacaacggaaacttgtataataaatgttaaattactattttgcc

SEQ ID NO: 5842 - DNA, 203 bp, Homo sapiens
gtagaatgagagagcctctaaccaaaatgtaatcagagtatcaagaggagagcgtgtgtgaaaggattataggccatatttgaagaactgatggctgaaaatatcttaaaactgatgaaagatacccatactagttttgcaaaaatgttgtagcacatacctgaccaaaaaggaatagaatttgttcttcataattgataata

SEQ ID NO: 5843 - DNA, 346 bp, Homo sapiens
ggctaattttttgtatttttagtagagagtagagatggggtttcaccttgttagccacagatggtctggatgctgctgacctcgtgatccagccgcctcagcctcccaaagttctgggattacaggtgtgagccgcagcacctggccaggcttttagtttttaaatattaggtagaggtaatctatttgtaagataacagattttctagaacagaggcttcgaatggtggttgcatattggaatctctggggagcttgaaaaaaaaaaaaatactgatgcctaaattccattccaaaaattttgttatattggttctggggttggacttgggctttgaaggttaaa

SEQ ID NO: 5844 - DNA, 603 bp, Homo sapiens
agagatctgaagtgattttacctttatttccttcactttaggccaattgggaaatttcacagtgatttctggggtgggagcagaaggaaggctgtgttaagaatcatcggggctgtggcccagtcagcccgcggaggtgcaggcagggtgggccctcactggggcagctggaggagcacggactgccccgctggcaggtaggtgatgttccgagagcgtgagagctggtacgcgatgtcctctgcagcttccagcttgcgcagctcgatcaggccatcccctgcagtggccagtgagttggcaatcagctcagctgccttggagtcgccctcagcagagatgatggccgcctttttctgttgctcagccttttccaccacaaatctggccctctctgcttcctgctgagccacctgtttggcttccaccgcttctgtgaactccttcccgaaggtcagatgtgtcaaggacacgtcatccaggatgagcccaaaggtggcggctcgctctgtaagtcgtcgctcacctgcctggagaccagctctctctgggtgatagttctccagcatcaaagcgagccaccactgactttgagatctcagt

SEQ ID NO: 5845 - DNA, 769 bp, Homo sapiens
  misc_feature 587, 602, 612, 671, 734, 752, 769: n = A,T,C or G
ttgcaaatgggacaattttaattcaaccacaagtcaaatagaaagaagttaaaagaatgtttatgcaaacacatgagaaaagaagggtgcagatgagaatgggggttggggagagaaagaggaggagtaagaaaagagggaaaagcaagggaaagtaaaggaagaaagagaaagaggggcaggaagagagcggatttggcccaaggtcctatcttggccgcatctctctgcttcttccccctgatgcttggtttgttgacaacacagcatcctgtgcctggactcccaattagcttgttcctggactgtgccccaggtcctccctcaggagggcacatgctgtcagtccagaccaaactcacattaaataaatttcaatatacactgtacaagaatgccaggcccatccctcatctcactggctgcctgacccccaaaacaaagctcctccccagcttctctgtgcatcaagggacatctgagggccgaagaggaagggaaaggaatagcttggttcccaaatcggcctgccatgtccatatataaagctaggggcaccatgtgacacctccccacccccaggagcnccctgcatggaccangctggcttanggagagtgcccagcagcagagtcccctctgagcatcttgtcacgtcacctggtcatagncaagtcccttgtcactgagcctagcatcagccaggggtaggtggggagagcgttcaagtgcanggagtactcctggctctnctgagacactgacacan

SEQ ID NO: 5846 - DNA, 556 bp, Homo sapiens
ctctatctccatggaaagccgcttcatgtcagtatctttgaagtcgaaagcaggctgtcaccaatgaggttgaagcttggtatgtcaggaggcaacggtgctggaattgggttcatgggcgggtacgtgggcttggtggcaatctccaggagcttctgcttggctcttcgctccgcctcggtgcttcctgcaggtcctgcttcagctgatctgcctctttggccctcctctctgactcctcagccatcttcagtgccagcacctcggcttccagcaccttctgctccatcaggcgcttctcctcctccgtgcgaatcgctgtggccttgatgcgctgcatttcctgctcagcctctgcggccttctgggcagaagttttgcctcctcctcggtgatctgggccttttcagccaacaggtcagctgtctcctcagaccgcatcaatgcttcgttggccattgttgcttcttctttcatctgcagcagcatcctctccaactcatccctcgtgcgttcagcctctccctcatctgcttctctcgacgaggggtgcgct

SEQ ID NO: 5847 - DNA, 606 bp, Homo sapiens
  misc_feature 93, 106, 585: n = A,T,C or G
gcggccgcgccccgggagggctgttcgggccagcgcccttcggctgctccgcgctgacagcgccgggctggggcggggcggggggctttgcangccgccagtgtcnacatgctgctggaggaggttcgcgccggcgaccggctgagtggggcggcggcccggggcgacgtgcaggaggtgcgccgccttctgcaccgcgagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctatctggcagctgaatctgatctccatcgcagggacgccaggggtctcacacccttggagctggcactgcagagaggggctcaggacctcgtggacatcctgcanggccacatggtggccccgctg

SEQ ID NO: 5848 - DNA, 415 bp, Homo sapiens
ttttttttttttttttttttttttggtttttttttttttttttttttttttttttccctttcaaaaactgactttattggcaaatgtggaaatattctgttaaacaatacagagatgatagtggtccttagggtaagcattaacaatattattcaaaatgttatatagagttcaactgtatacaataaagcatttattaaagtgtgtccaaagtgcttataaataaagcatcttcgaggcaggcggctcacttgaggttaggaggaaagcaaactggccaacatggtgaaaccccgtctctactaaaaatattttaaaaattacccaggcatggtgacccatgcctgtaatcccagctacttaggagcctgaggcatgaaaatcgcttgaacctaaaaggcctaggttgcagtga

SEQ ID NO: 5849 - DNA, 457 bp, Homo sapiens
tttttttttttttttcttttttttgagagtggagctgctttattgcccttggagcccgcgctctcggaggctgtcttctgtcgccaagggtcccggaccgagtacacggtggcagctggcttagttggtggacggcttggcccactcgacgttgaggatgaggtggtcgtagccaaagccggacaccccggcaatggcacgcgcagcatcctcgcggcggtggaagctgatgaaggcgaagcccttggattggccagtggtcttgtccttagccaggtagatgcgggagatggagccgaaaggccggaagagctcctgcaggtcggtctcacgcgtgtcctctgacaagttggtgacacggatggtggcgttgtcgtcggctctgcggttgggctgcatggactccccgcggcggctggccccgtcgcgcaggctcggcggcacatacttccctgtc

SEQ ID NO: 5850 - DNA, 548 bp, Homo sapiens
tttttttttttttttttttttttggtttattgaaagaaatgtttacaacatgacaccaacagaagggatcaaagtgtgtcgtgaaattgcgagtcttcattcctttttcttggttctttgtattcaaagatgctatttagtgtgttctgttcttcatcttctctcttgttcgttttccaggtctcttatttgaccctttcttgccaggcctcttgaggcctctgccatgagctgtcttggcccggaagctagatacatcatcatagctctcccgagtgttccactttgagcctttcttctttccaccaaaaccaaacttctggtttttataccgtcgtttagcactgggccccttcctcatctgctggcctttggctcctgccttcttgcgctgtgccagaggtttctgatctccctcaaggaaatccagtttatcagagaagcctttctgatatttcttaatagcattcatcatatgggctttctcctgctgcctcttctgaagaacctccgtttgcaccttcttcccgtatttcctaagtgctcgc

SEQ ID NO: 5851 - DNA, 519 bp, Homo sapiens
tttttttttttttttttttttctcatttaacttttttaatgggtctcaaaattctgtgacaaatttttggtcaagttgtttccattaaaaagtactgattttgaaaactaataacttaaaactgccacacgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtcccatatcacgaacagcaaagcgacccaaaggtggatagtctgagaagctctcaacacacatgggcttgccaggaaccatatcaacaatggcagcatcaccagact

SEQ ID NO: 5852 - DNA, 480 bp, Homo sapiens
ttttttttttttttttttttttttttcgcatctaacagtccattttcactgtttccaaataccatagcaacctcttgccctttgtgttacccctagagagatggcacccaatccccagggttgctctctgacttccaccattcactgacttttattgccagaggagctcccaggaatccacagttctggaagagaggggctctaagtctttattggggagaatacccacccaccttccctcactgcagacgatagacacactcagtgtcagggtagggtggcaggttcagctggtacttcttttccagagcaggtggcacaaaacgaccccccaggtaatggtagcgaccggtaaactgggttgcagattttttgggggctgtgagggagatgagcaagtctggctggatccctccagcatttcccttctccacgtcccatcctgagggaatgtcgatgctggcaatgggcacagtgagt

SEQ ID NO: 5853 - DNA, 567 bp, Homo sapiens
tttttttttttttttttttttttttctgggtaattacatttactgctcttttacatgaatggtatatcataaatacggcttaaaatttgtttgttattttcatttaacagatatcttgaacaaacttccatggtatatattatagctagaataacctcattctggaataatctatagtgtgaatgtaccataatttgcccaatcaagcagaactataatgtttggcatctgaatcagttgcaaagattgtaggttaattgcagttataaaaatagagcttggaaattgcaactgccccaagttcttcacggctcttatgcaaggctgtgtcctaaagccatagggaagtttagctttcagttgcctgtaacattaaggttgtttcatgattttttgaaggtttgtttcacaccatttccccccttaaatcatttaaccgaatggtatgtaacaggtgtagtttctaatgagttcttttcttcccctgtggctttagcatggcacattacacttctgtggatttaaagtccttgcccctcagatcagctttgctcctgaaattgcatc

SEQ ID NO: 5854 - DNA, 538 bp, Homo sapiens
tttttttttttttttttttttttaccaaacgattgcatttattataaacaagtgtacagaccctagactcagaaacacaacagatttgagctaagacagctctggtgaaacagtaatagagggaggaggaacacaaggtattcatgtctgggccagagctgccatccagggccccacaccccacctttggtccagatggcccattggcccaggtgtccctgctgccagaacaccgtggactggggtacaggagttgttgcatattccatgaggctggtgtcgggaagcagggactcacagttgccaggttgtccatctctgagccaatttccctccacaacccaggggtttcagtctcatatcaactgtcatgtttgaaacagaaaacaggcaaaatgtttggctaaaataaaatgaaaacactgcagggaagagaactgagtgtgctggtggacaggagccctgctcacctgtgggaagggcagggccagcaagggcagcagagctccctgggggcagctaggctgtgtgtgcatgt

SEQ ID NO: 5855 - DNA, 574 bp, Homo sapiens; identical to SEQ ID NO: 2610

SEQ ID NO: 5856 - DNA, 491 bp, Homo sapiens
ttttttttttttttttttttttttttggatttttagtagagatggggtttcaccatgttggccgggctggtctcctgacctcaagtgatccacctgccttggcctcccaaagtgctaggatgacaggcatgagccaccatgcccggcctatttttaaatttttcttaagacagagtcttgctctgtcacccaggctggagtgcagtggcgcaatctcggctcactgtaacctccatctcccaggttcaagcgattcttctgcttcagcttctcaaataggtgggattacgggtgcccaccaccaagcccggctaatttttaatttatggtagagacagggtttcaccatgttggctgggctggtctcgaactcctggcctcaggtgatctcccctcctcagcctcctaaagtgctgggattacagacctgagccaccacgcccggccgaataataggacttttaaaagtcctatttcttggctctgctatt

SEQ ID NO: 5857 - DNA, 547 bp, Homo sapiens
tttttttttttttttttttttttttttctttttttaaaaatttaaaataaaattttattttatcttatactcaagttcagacaatagcatgtggtgtacattcaaaatttttgacaggtacagagcacattaaaaaatgaagacatgatcaaggagatgtaagagacaaatagacaacaacattctccctgaatctggaaaaaagcaagcaataagatcacgaaaggcagctgtaaaacaggattattctgcatgtgttgcccacaactagggcaaggttatctctcatcacaagtacaaagccattgatgtcagtgtgtaacagagagaaaacagaagatttgtacagctgaggaaataaatggcagatgttacacaggaagcaatataacatggtcattaagtaactgtattcaaccatcaaatttaattttaaatcttggcacagtgcccacaagccgtgtgactttagtccccttgataatataaacttcatttctctcacttataataaagagacacaaatggtacctactccataaagtta

SEQ ID NO: 5858 - DNA, 438 bp, Homo sapiens
tttttttttttttttttttttttttccatctgggtacgtgaactagaacgtctcagcagtatttaaataaaagctgtaaggctccaacttcaactgaaatgcctcgggaatttgtaatcatgccctgaccttcccacctcgtctactccctctgcaacttctcattctcccttttctatcttggggtcaattttagcttgcaaggggcccatgtgctctggatcagagaacaaaggaaataagcttcatgctggccagggggtactagttacatcaaaagttctcaaacaggggtatatatcagatctcctgggccaagtgctaacatgaacttcagactcctggcccttcccctgtagaggcaaaagctccagtacaggaatctgcattttttttgtttgttttttgtttttgtttttgttttttgagagggagtct

SEQ ID NO: 5859 - DNA, 70 bp, Homo sapiens
gtgcagacacgcagtgctgatgagcccatgactacctttgtcttatgcaatgaatgtggcaatcgctgga

SEQ ID NO: 5860 - DNA, 517 bp, Homo sapiens
ttttttttttttttttttttttttttttaggcagggtctcactctgttacccaggctggagtgtaatggtgcgatcacagctcactgcagcctcaacttccctggctaaagcggtactcccacctcagactcctgagtagctgggaccacaggtgtgcaacaccacacctggctaattaaaaaaattttttttgaagagatggggtctcaccatgttgctcaggctgactcaaacttctggcttcaagtcatcctccttcctcagcctcccaacatgctgggattacaggtatgagccacgtgcccggcctaatgataaatcttgtatatttttacatatttacagagatcttgtgatttttctcaaaagccttataaattcaaggacctcgttctattgataagatttccaacaactagatgtccaaccgaatccaaaaacatgcagaactctcatattctatgaatctagcgattcaaccaacaggtcagaattcttacaaaaccctaaaaatac

SEQ ID NO: 5861 - DNA, 188 bp, Homo sapiens
tttttttttttttttttttttttttttttgcagctcactccaggtttatttcagggcagtttgagggtgggggacaaagacccccctccagctcctaaactgggtcacttttctcccaggtgaaggggaccatcctcatgggatcctatcgatgtgagagctttgtgtccaccaggtgtggctgggtg

SEQ ID NO: 5862 - DNA, 375 bp, Homo sapiens
aagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggacctagtgaatattgagatgttcctgacg

SEQ ID NO: 5863 - DNA, 537 bp, Homo sapiens
gggtaggggttggcgctcaggcggcgactatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctatatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccatgacctgaactgtgccgactccacaaaacgattatgtactcttctg

SEQ ID NO: 5864 - DNA, 536 bp, Homo sapiens
atatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataagttatttggggttgtctgggattgtgtgaaagaaaattagaaccacgctgtatttacatttaccttggtagtttatttgtggatggcagttttctgtagtttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaagaccttaaataaacatgattgatcaatatggcagatgatttacagtccattatatgacatttgtaagccactcaacact

SEQ ID NO: 5865 - DNA, 523 bp, Homo sapiens
ttttttttttttttttttttttccccacaaatcaattctcatgactgcacttcagagcttgtcctcttaaggtaatttgagtatgtttaaattaataacgtgacagtattcaaccagaaaataaataaatgaatatatatacacacacacacacacacacacacacgtgtatatatggctttgtgaatccagatgaagtcagttgttgagaaggtaggtgggcagatattaatagaattggtgttgtacaaaacaaggatgaaagaaaagtgaggtgaagaggatggagttgttgacaaggtaggtgggcagataataggattggtgttgtacaaaacaaggatgaaagaaaagtgaggtgaagaggatggttttgtagctggataggtaaaagggtaagctcttacgcaaagatgtattacagagcaaatctcaagttttctgactgcacagttcaaagtttcaactacacactttacctaacagttttgaaatattataaagctttattccattctaatat

SEQ ID NO: 5866 - DNA, 622 bp, Homo sapiens
ctgcagtttggggtgctacttctgcaccatcctccttttgctctgggtgtctgtcttcctctatggctccttctactattcccatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgac

SEQ ID NO: 5867 - DNA, 479 bp, Homo sapiens
aagtgaatctagctctgaaggcatggcgcgtacgaagcagactgctcgcaagtccaccggcggcaaggctccgcgcaagcagctggccaccaaggcggctcggaagaacgctccggccactggcggtgtcaagatatctccatcgctatcggcctggtacagtggctctccgcgagattcgccgctaccagaagtccaccgagctgctgatcagaaagctgccttttcagcgtctggtgcgtgagatcgcgcaggacttcaagactgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagag

SEQ ID NO: 5868 - DNA, 553 bp, Homo sapiens
agtgcttcgaactactgggagcgactgctacggaagcttccgcagagccggccgggctttcccagtcctccgtggggaccagcattagcagtacagggcccagccatgtttacagagccagcaaatgataccagtgtaagtaaagagaattccagccttttggacagtatcttttggatggcagctcccaaaaatagacgcaccattgaagttaaccggtgtaggagaagaaatctgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatt

SEQ ID NO: 5869 - DNA, 565 bp, Homo sapiens
ccggcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaataactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtatctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagag

SEQ ID NO: 5870 - DNA, 538 bp, Homo sapiens
aggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctgcgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagt

SEQ ID NO: 5871 - DNA, 602 bp, Homo sapiens
tcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttat

SEQ ID NO: 5872 - DNA, 526 bp, Homo sapiens
ctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcgcgggggttgtgaatgcccaggcccttaccagtgccttctctccacacaccaagccttggattggtctggcagaagctctggggacactgatgcgagcctggactgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgcccctta

SEQ ID NO: 5873 - DNA, 545 bp, Homo sapiens
atttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatccgaagacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatc

SEQ ID NO: 5874 - DNA, 479 bp, Homo sapiens
taagtgaaaggctgctgcagcaccgagaaaggaccgatgcaggaaggcaccaaacttggttctaatcttggctctgctaacaaattggtgtcattgcacaggtcacttcaattcttctgggcctcagtttccttagatagtcccataggtatcatttcagatatttcccaatgcgatactgttcccacttcatttactgttgccctaacttgagagagcttgaagttagaaagagatttatacacaaaacaccagcaggagcgatttcccttttttgcaaaatatctttataatttcagttaaacatgtattttcttaagatttgtggctttgtaataactcttgcaatgtcagcagttttcctcggaaaaggaagcatttcttaattagagcatacccacaagatactcccaaatagttaatattttatattctggaacttattcctatctgtttgaaatcgaatgtagtcaggaatt

SEQ ID NO: 5875 - DNA, 650 bp, Homo sapiens
agagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctctttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattct

SEQ ID NO: 5876 - DNA, 334 bp, Homo sapiens
atgcggcgcgccgcgcgtgaacctccttggcctgggcgaggctgggtggaccaagcaagtcaggagtgtggacatgttttctgagcaggctgcccaaagggcccacactctactgtccccaccatcagccaacaatgccacctttgcccgggtgccactggcaacctacaccaactcctcacaacccttccggctaagagagcgcggatttagccggcagtatgcccacatttatgccacccgcctcatccaaatgagacccttcctggagaaccgggcccagcagcactgtggcagcggagtgagagtgaaaaagctgagtgaactgcagcct

SEQ ID NO: 5877 - DNA, 644 bp, Homo sapiens
gggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatgggtgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaagcaatgatcaaagctgaagaaagcagtaagcaagaagagtgcaccacaacatcaacagccccagtccctacaacagaaattccgaccacaatgagcaccatggctgctgccgaagcagcagctgctg

SEQ ID NO: 5878 - DNA, 483 bp, Homo sapiens
gcgctcgggtgaggagctggtggcgtcggcaggttcgaggcgattcgagctccagctaggatgatcgaggttgtttgcaacgaccgtctggggaagaaggtccgcgttaaatgcaagtatccactggcagccgagaggcagtggtacccgcaggggtgcttggcgtgaggcaggcaactcaatctgtgttgtcggatggttttagttaaacccgggagagggggcggatggggtcctggcagatggtattctgccctagaatgtcctcttcctcgttctaccgcttccatttgccttaactgctctgcgcccagcacggatgataccatcggggaccttaagaagctgattgcagcccaaactggtacccgttggaacaagattgtcctgaagaagtggtgagtgcagcggtagagccactgggtggactggactaggccggaaggttttggttgggggagcgctgcaggcagccctttgctt

SEQ ID NO: 5879 - DNA, 454 bp, Homo sapiens
ctcagtctcatgtttcttgggctcttgacccttgctttgccttagctaccacctcatatagtaacagattaccagcaggtttgtatgattcctctgcttgagatcaattagccatatgttcagaatccctggcctataacaacacttctgtgctttaaaaaccccatgccacaatgactgttaaaagggctaggcgatgtagtctggtaggtttgtgaagttaactgtctgaaaaacttggatcaatggactagaaaaagctgctgggtaaattgctcttcttctgatggactgtatagagacactgtttttcatcttgcctgtccagaagcgtactctgtggccaagcaagtgtacttgccgcatgattggcagtgtctcttcatggcttttcatgaaacagcagcaagtgctacacagtaatttatcagtttgcatttgcctcccattattg

SEQ ID NO: 5880 - DNA, 500 bp, Homo sapiens
tacggccgggattgaacgagcaggctattctttggagaaggttttgggattcaattgaaggaaattgataagaatgaccacttgtacattcttcttagcaccttagagcccactgatgcgggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgcgaagcagaagtacctggactatgccagagtccccaatagcaatccccctgaatatgagttcttctggggcctgcgctcttactatgagaccagcaagatgaaagccctcaagtttgcctgcaaggtacaaaagaaggatcccaaggaatgggcagctcagtaccgagaggcgatggaagcagatttgaa

SEQ ID NO: 5881 - DNA, 456 bp, Homo sapiens
tgcaggtaggtcattaacaccacttcttttcatctgtaccacaccctggtgaaacctttgaagacataaaaaaaacctgtcagagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaatagatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgaacatttgattattacaatttagttttcagtaatcaaaa

SEQ ID NO: 5882 - DNA, 347 bp, Homo sapiens
ctgagtgtgaagtcagcagagctgttactgtggcaacctaatattgtgacctccatcttgaagagtctgcacatttaagctggggatagcgtttcttgacttctgtgaggctccggcaggggaagaggaagcattttaatacatatgcctctcttttacaaaaaagaaaaaaaaatcatcgtaggccctaacatgtaccatgttgacaaaaatgccagatcaaatggatttgagaaataagcccaattcaaggctggctcagccctccacggggcctctcagggaaaggaattcctttatgttcttggaagcccttttctagaaaagccattccattcatacctttg

SEQ ID NO: 5883 - DNA, 578 bp, Homo sapiens
gagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctctccccatttctgattgtcgtatagctttcgattttgcttacagtagttcccccttatcttcgggagatacattccaaggtccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtggatgtggttggtctctcttgctttcaaaatatcttcttgtacagtactcacctattttagaatgtggttgactacaggta

SEQ ID NO: 5884 - DNA, 618 bp, Homo sapiens
ggggccttttggctctctgaccgcaccatggcggttggcaagaacaagcgccttacgaaggcggcaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaagaatggcagacaatgattgaagctcacgttgatgtcaagactaccgatggttacttgcttcgtctgttctgtgttggttttactgaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacataga

SEQ ID NO: 5885 - DNA, 490 bp, Homo sapiens; identical to SEQ ID NO: 1451

SEQ ID NO: 5886 - DNA, 628 bp, Homo sapiens
gccagttagttttactagtggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatg

SEQ ID NO: 5887 - DNA, 542 bp, Homo sapiens
gaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtaccagttctggaaaacagtcagggtcagctgatctacgagtctgccatcacctgtgagtacctggatgaagcatacccagggaagaagctgttgccggatgatccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaacaatgaagtaaatgagtgtgt

SEQ ID NO: 5888 - DNA, 469 bp, Homo sapiens; identical to SEQ ID NO: 1456

SEQ ID NO: 5889 - DNA, 536 bp, Homo sapiens
ttatatcctagcactattttacagcctaaggtgtgtgttagtctattcataaaaacatactgctgcatagagcaataatacctgccattatctaggtgtaataaaaaggtcccaagtggtcctctccaggtctttaattttccttttgaagataaagctccttctttcactttcatggttcaagatttttggaccttgcaagtgattgctattgaagtgtgccagatgtgagcagttgtgagcatagtactttaaaagaaggtgaaggagtgactttttcttccttattgtctcccctactaccatctgtagtttctacacatgtaacttttccaaaacagcaaggcatgggaagggataccagccagggccgccacagtccaggcatgggacttctgaagtgaggagatagagatgaaagcggcctgtattgataaatgacagatgatgaaaccaaggcctgctggaccaagattcaatgacttacccaaagctacacagcttgttggtggcagagttagctcccaatccccagc

SEQ ID NO: 5890 - DNA, 578 bp, Homo sapiens
tgggtggattgcttgagctcaggagttcaagaccagcctgggcaacataacgaaaccccgtctcgttatacaaaatacaaaaaagttagccaggcatagtggtatatgcctgtggtcccagctactcaggaggctgaggtgggaagaggatcgctggagcccaggaagttgaggctacagtgagtcaggatggcaccactgcactccatcctgggtgagagcaaaaccctgtctcaaacaaacaaaaataatagtaataaaaataaggagaagaaaaaatcagtatgtggagtggctattaggttagtgggagaagtctcaagaacaccatacaaaataatagaagggggatggaaggaaacaacttacaagaaaatgtacaaagcacttaaaatatttgagatgaatgagaatggatgagattgctgttgcttttctaacaggtcaatttcctcttctatcagcagagcacttgtgagtcagaatgtaaagggatgtgatgggatgaagttaatactgtgccctctacaagtgtaaagaaaagtctttgtttcttcttttttgtcttgagatgatct

SEQ ID NO: 5891 - DNA, 534 bp, Homo sapiens
catgtcactattaatcagaattcattcttgttattctctttaggaccttaggcaaatgcataaaatagatgaaaatatgtctttgacagtcccactgccgtaagaaaaaaaaagctgtgtacctttttttaatgtttctattctaatcttttcaacatctttgtaagcttgagacaactgattttaacataacttaatttggtactcgcttcttatcccttcttttcactcatactttctcctttttatgactccatcttctctatatttttgctccttttctttgtccccaccccctgtctcttttcacatcttcctttctttctcctattataagcttcttgaggttaggaattgtttcttttttatttctctagtctgtacagtgctgctgggttaaagtgctcagtggttaccaagacgtctgaataattcattattcgagcccagctctagtacaactattctatattaattttccttgctattttagcctgtattggtcttttgtatccccaaatttgtcattttggt

SEQ ID NO: 5892 - DNA, 528 bp, Homo sapiens; identical to SEQ ID NO: 1458

SEQ ID NO: 5893 - DNA, 396 bp, Homo sapiens
ataggaaagatctctatatggatctttatagatagatctaatatagaaagatctatattctgcatattttctcagtcatgataaacaggaacacttgaccagatcttctaccccacacagcatagataacatctcaaactcggtaaactgttattctaatagatttttttttttgaaacagggtcccaccctgtcactcaggctggagcacaggggggtgatcacagctcactgcagcctcgacctcctggactcaggtgatcctcccaccccaccctaatgagtagccgggaccacaggcatgcgccaccacatccagctaattttttttgttgtttttggagaaatgaggtctccctgtgttgcccaccctgttctcaaactctgggcttatcc

SEQ ID NO: 5894 - DNA, 521 bp, Homo sapiens
gcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagggcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtatcccctggggatggcgcatcacacaccaaagtccattttcgctgcgtggtgtttcatccattcctagatgagattctcattgggaagatcaaaggctgcagcccagaaggagtgcacgtctctctaggcttcttcgatga

SEQ ID NO: 5895 - DNA, 505 bp, Homo sapiens
cagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccccgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcgccgttgtgcgtggcaagtacgactgtggccacgtgcagaagaagtgacggctgggggcacagtgggctgggcgcccctgc

SEQ ID NO: 5896 - DNA, 624 bp, Homo sapiens; identical to SEQ ID NO: 1461

SEQ ID NO: 5897 - DNA, 448 bp, Homo sapiens
tataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaatatttgtacatatgatctaatttag

SEQ ID NO: 5898 - DNA, 624 bp, Homo sapiens
tggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccacaaaaa

SEQ ID NO: 5899 - DNA, 624 bp, Homo sapiens
tgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctgaatgttgctctctaaagacctttaataaaattttgtacaaaaaaaaaaaaaaaaaaaaaaaaa

SEQ ID NO: 5900 - DNA, 623 bp, Homo sapiens; identical to SEQ ID NO: 1462

SEQ ID NO: 5901 - DNA, 563 bp, Homo sapiens
tacggccgggtggagtggctcacgcctgtaatcccaacacttctggaaactgaggaggatcatctgagcccaagagttcagagacgagcctgggcaacatggcgagaccccgtctctacaaaaaaattttaaaaatcagctgagtgtggtctcactagcttatggtcccagctactcgggagactgagatgggaggatcgcttgagagttcaaggctgtagtgagctataatggagccactgcactccagcctgggcgacagtgagaccctgtcaagaatactccaatacaaaagtacaaagaaagatagatgaaatcatgtaaaaaaaaatggtaaagttcaatggtaatgataggaattcaagcaggtgtaaaatgaaaaaagactatcccaatgaagtcagggtatgggaaacaatgtcactgactctccgggattgtcaacaatcacaatttgggaatattggcatcactgtcaaaatgtgcatacttttaaacctatcattcttatgagcgggaatttatcctgatgaaataactagacaaatatgcgactattcatt

SEQ ID NO: 5902 - DNA, 557 bp, Homo sapiens
tacggccgggtactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtaggggtaagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttg

SEQ ID NO: 5903 - DNA, 543 bp, Homo sapiens; identical to SEQ ID NO: 1463

SEQ ID NO: 5904 - DNA, 432 bp, Homo sapiens; identical to SEQ ID NO: 1464

SEQ ID NO: 5905 - DNA, 530 bp, Homo sapiens; identical to SEQ ID NO: 1465

SEQ ID NO: 5906 - DNA, 564 bp, Homo sapiens
tgtttctgcatggtaatgtcatgtaaatgctgatattgatttcactggtccatctatatttaaaacgtgcaagaagaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgt

SEQ ID NO: 5907 - DNA, 407 bp, Homo sapiens
ggcacgaggagagagagaagaggtacacatagggctataatcatagatcgaacacctttaaagaaacacgaagaacagctggaattagaaattaataaaatggccaagattggtaataaggaagcttgcgcagttttatccaaacaacttgtgcatctacggaaacagaagacgagaacttttgctgtacgttgaaaaggtacttctatgtatacacaaacaaaagtgatgaagtcccaaatgaagatggctggagcaatgtctaccacagcaaaaacaatgcctgctgataacaagaagatggatccacaaaagacattacaaacaatgcagaatttccagacggaaaacatgaaaatggaaatgactgaagaaatgatcaatgatacacttgatgacatctttga

SEQ ID NO: 5908 - DNA, 300 bp, Homo sapiens
gagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggc

SEQ ID NO: 5909 - DNA, 230 bp, Homo sapiens
tttttttttttttttttttttttttttattttttttttttttttttttttttttttttttttttttttcggaggcttttcattatcacagaacacaccccctgtaatgggtgcaaaaaggaaatgaggggtggaaggaaaggaagtctaattgggaaaggctggatgggcacttcatttcttctctttcttcttatccttttcattcatggccaggatcatcatgagttt

SEQ ID NO: 5910 - DNA, 558 bp, Homo sapiens; identical to SEQ ID NO: 1467

SEQ ID NO: 5911 - DNA, 384 bp, Homo sapiens
tttttttttttttttttttttttaaggcctggcttcttctgctgcgacacctgctgcttcattgaggtacttgttaccaactttgctttcaaaccattttaggtgcacaaaaacttcactgaagtgctcccgatcaaaatctgatagtttcacaaggtatttctcaaatcgaggtaagttgaggtgcccactttcattaatataacccccaagttctggcaggatggtaacatatgttccataaagaagaggcagtgcatcatgattaatatgtaaatgaggtagatgagggataaaatcattaccaacaagaaaccccatcaaaatccaatcatctattatcctttcaatatcatatttaaatgtgatcttttcttttaatac

SEQ ID NO: 5912 - DNA, 422 bp, Homo sapiens; identical to SEQ ID NO: 1470

SEQ ID NO: 5913 - DNA, 442 bp, Homo sapiens
ttttttttttttttttttttttttggcctatttactgaaagtttaacgaaataaaaaatagaataataaaacattcaaggaccaagggataatcaaaaccaagtacatttgaaaaagaacaaaatagaactttgctatactccataatgataaaataaaaatccaaaaataagatgtaacattcaaaaccttatatgcacttgactacagaaccactactatgtcaataaataactgacagaattagaaggagaatttcaaatttacaattgtagggtaacctttcaatattctgtatgagtgttaaattctcatattacaagcaaagaaaaatgctaatggttttctaggatttgaacaagacaataagcaaatttgatctatgattaccttcatttgacacagaaaacatcccttctttttttcaaagcacacgttggac

SEQ ID NO: 5914 - DNA, 492 bp, Homo sapiens
ttcaaccacaagtatttattgatggatcgaagatacaattttaatggaacaataaggcacaaccgtggattaaaacactttgctatacagccaaaaggggggaaaatctataaccttaggaactttatgccaatcaagaagcctctaaagtacctctctaatagatcagtatcagacattcttcccttttacataattcctatattacatcacttaatcataaaatctgactgatacttcataaagaattcctcattcatttatatttgagccatccagcctggctactcccctgttctccacccttttccatcactttgcagtggtattttttagcaatcttcaatagttttccaaagcaaggaaacaagcaagcaagcaatgagtcagaaagtcaaccaaaggcagatgtgtggctaaatacactcatagagacatacattaggatagcaatagcctgattcacttaagtctaaactaagctgacttggc

SEQ ID NO: 5915 - DNA, 463 bp, Homo sapiens
gatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatct

SEQ ID NO: 5916 - DNA, 589 bp, Homo sapiens
ttttttttttttttttttaagaaaaatacagtttatttcaggcttacagtaactttcatagcactgctgtgctccgttcgttcatctgtttggttgtccaaagtaccaggctgctagggtgggcccagaaactgctcccttgtaaactctgaagctgagctcccagaaggctgattctaaggctactactcacaggtcaagccacagattaagcagtaaggtattatttattaagatcttaagcctcacccctgaactcaaatgggatgggataaggagtaaggaaagaggttagaggagacagaaaacaaagcccagctcttccaagctcaccacctagccaaggtcttcgaattcctgagggaacccaggactggaggctgggctgaaggaaggcagcattcctgggaggttccaagttctgggcaggggtacagagctgttgcgtgtgtgtggggtggggtaagggagaggctccagagctactttcattcacattttcaactattctctcttccacttgcatgttcatctcaccattcctgacccagccagccccctatcactgagtactgctgctgctgctgat

SEQ ID NO: 5917 - DNA, 440 bp, Homo sapiens
tctggacctcccctgaccactgggtccgccccggccccttgcagagtttccctcatcccgtccttctcccctcacggttctggggccgcccaacctgttccggcaccacctcccgccaggagaggtccccgaaccacgaggacaagctaagtgcggtggatatgggaatctaaataaatacgaaattggggtttccaaagcgttttcacaggtcagtctcataaacgtatcgtgagctgttttacgttcacagaaacttcagtgatcttttccagggtggaacagccagccccaggttcatttgctgggactggaattcacctcctctgagtcatgctggttatttaaataacgtttacaaacctttgttcactaaaccaggttttcagcattcagtatcgcatgttggtttttaataaagcgatgtcatttcttgcagt

SEQ ID NO: 5918 - DNA, 349 bp, Homo sapiens
tttttttttttttttttttttgagggaaaagttttaaatttttaatgaaaaagacttagaacaatgtattatttacatgtaaataagaaaagagagcagaatccccatatcctcttcaaaggaagggagacggcaggccatttatgagaagaaagtccatataaaccctattaagtagaatctggatctaaatacttccaaacaggagtacacagcaggtgaacagtctccctcatcccactgatctgctgcttcagataagatcagcaacgttcatcggcatctcatcaatctgagtggaatagtactgctcgatatctctgaggatgcggatgtcgtcattctttac

SEQ ID NO: 5919 - DNA, 566 bp, Homo sapiens
ttttttttttatttttttttttgggacaacgtttcactctgttgcccaggctggagtgctatggcacaatctcagctaactgcagcctccacctcccaggttcaagcagttctcctgcctcagcctcccaagtagctgggattacaggtgcccgccaccatgcccgactaattgtttgtatttttagtagagacggggttttaccatgttggccaggctggtctcaaactcctgccctctagtgatttgcccgcctcggcctcccaaagtgctgggattacaggggtgagccactgtgcctgtccagcagaactttttaaaacttggctttgttgcccaatagggagaggttttatttttcttattttgaataatgacttgaattttgttaaaatgataaacaattgaagcagtaaagacaaaaattcacttaatctcaccatcagaaaaaaaaaatcattgcttaatattaagtggcattattccagacattcatgcatgtcagcagatagaaagtctgatacctagatagaaacaattcttgaaaatagcattaccatgtaatt

SEQ ID NO: 5920 - DNA, 582 bp, Homo sapiens
tttttttttttttttatcagataagagctcagcctttattgtgggctcagaagggcacaagagcagaacatgcagaggactggcagcactctggcctggccatcaggccaaggcaggcagcagcaggcacccatgcagctgcagcagcctcacttgctgcacttcctgggggagcatttgcactccatggcattgagaacctcatggtacacaacagagccattggtgcagtgcagggccacctgcatgggctccgtccgtgtcggagagcagcaggagcactggtcctgcacatcgttgatgtcaatggagtacatggctttgctggcacatttgccctggcagtagtggatatccacctctacttcagacttacagcttcccaccttgacatactgcagcctggcagtgatgtcgttgcactcaggctcctcacatgtgtcacagcaggtgcctggaatttacataattttacctccctcagccagacacttgtgttcatcaaagggtgggcagcctgtgaccctcttctcccagaagtactctcctctctcattgaccttgcagaagtgagtatcacag

SEQ ID NO: 5921 - DNA, 611 bp, Homo sapiens
tttttttttttttttttttttttttaaatttcttttaaattattttatttttgtataagctaaaaggaaatttacacactgaaatttcaaaagaccttgggcatgcacattaaccttgttagaggttcttctacatgtctctcttttttccataggaatttccccaaacatttaaaacccatagttttcactgtatatacagcctaaaccatagcaatctatgattatgtcattttacactgtgcaaaatcctcaaaaaatagtggtacaatagaacaaaaaaatcagtaacaagtaaattccattgtaagacgttcatataatttggtccttctctgaatcatactgattttaaacagacacaatctctttaaacccctccaatcaagttctgacaatgatccataaccaatactaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatctctccctcactaaacgtaagccttctc

SEQ ID NO: 5922 - DNA, 592 bp, Homo sapiens
tttttttttttttttttttttttttttagatcacaggaattttaaattgcagatcagtcatgctacttggggtgatcagaaagacttgaacacttaccaagtgaataattttattaaggtcctgaaggtgagtgtccggaggtgctgggtaaaacacatcacaggtaagaaatgggaaacctacctcagcatttctgaaaggcacaatctatggaagggaaacctagcgtaataaaaccctcactggatgtacatggaaaggagtatggtgagctatttcctttttaaaggatgagacctccataaattggcccctcggattctggtgattcccgccgcaagcgcaaatgctccagtgtgttatgaaaatgtttgttaatctgctctgtttcttcactggattcaagattcgggaggtcttctcgaatcttttggataagctggtttaaaacctgaattgttgccgcatcattttccttttcataaaaatagatatatctgttcagaatttctataaaaagctgcacttgtagagaggggtccatgcactgatttgctatttttagagctttttttaggcactccattaccc

SEQ ID NO: 5923 - DNA, 433 bp, Homo sapiens
tttttttttttttttttttttttttttggtctcaaaacatccccatttaatagccactcaggaagggtccatcatgcctgtctagatcattaacaggaagatggcacagatacacaccccaccagatccgtgtggcagagttcatgaataagagaatgcccagggggtcaggatgagagttggggcttccagatgcaaccacctctccctacttggagatgctctttccattaccagctcaagaatctggtcttgttgactaaggaaagaggcagtttccttacatgtttgctgaaataaacacacataaagtcctccatccgacaagagttgctgatcttcagtgcctttctaccaaaagattttcttacaaatgtccttctctcctcaaatctgagcacatcttgtgtttttttaatcagtaaaaaggtca

SEQ ID NO: 5924 - DNA, 566 bp, Homo sapiens
ttttttttttttttttttttttttacctgtccatagactttattatttggaagggggaagaggaggtccttggcactggttgggatggaagccccaggggcaaaggtttaggagttccagggctcagctgtcactgggcagggcaggcacaccggcaagggcaggcagcaggcgtgtatatatgtccaccccacggaggaacacagcctcatgcagccgttcatcgtggtcgtgcagcagcacaggtgtgcggttcatgggtgagaagcctagagctgggacccccaccgcgcggatatagcggttgtcagtggcagcaggcatgatctcaggctccagagtgaggttcatatccttgcagacccggctaaaagctgcccaccaagggtttgagtcatcagtaggtgtcacttgggggtgcatccacttctgagcaaactctagggtgaccccctcgccagctgcctggcaccagctctgcagctgctcctcaaaagccttgaagtccacatccggtgccacacggaagtcaaagctggcgctcatggtggcaggtatcacgttat

SEQ ID NO: 5925 - DNA, 527 bp, Homo sapiens
tagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttc

SEQ ID NO: 5926 - DNA, 83 bp, Homo sapiens
gcaccccaccatgagaggagccggtgcttttccatagctccctgatggtctgagggacccacccctgccccactttaccatag

SEQ ID NO: 5927 - DNA, 609 bp, Homo sapiens
  misc_feature 548: n = A,T,C or G
attgagtccctgaccaaggacaaggtccaggccggggacgtgatcaccatcgacaaggcgacgggcaagatctccaagttgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccacccnctacagcgagaaagacacgaagcagatcctccgcatccggtgcgaggaagaagatgtggag

SEQ ID NO: 5928 - DNA, 592 bp, Homo sapiens
ccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggaaacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgactactacatccctatcttctagcgtcctggcccaaggctctcaattgcactctttgtgtgtgtgtgtgtgtgcgcgcgtgtgtgtgcgtgtgtgtgtatgtggtctgagacaagcctgtggctcacctgcct

SEQ ID NO: 5929 - DNA, 472 bp, Homo sapiens
cctttcactttacggcgagattaagctcagggtcaagttctgagcaaaaagtgtcaaggagcctttttgcaaccccctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaatatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagagctggagtacagtggcgccatctcagctcgccgcaacctccacctcctgggttcaagcgattctcctgcctc

SEQ ID NO: 5930 - DNA, 621 bp, Homo sapiens
gtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacctaccttttgtaaacgttccatttcttttttccctcatttttgactcttaaaggtgcaatttattactgaattgggatttctggcagcacagaactgctttttattttggggtctgtgagtttc

SEQ ID NO: 5931 - DNA, 461 bp, Homo sapiens
atggtccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaacgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgc

SEQ ID NO: 5932 - DNA, 524 bp, Homo sapiens; identical to SEQ ID NO: 1476

SEQ ID NO: 5933 - DNA, 443 bp, Homo sapiens
catatcaaggttcctgattcagcactttgctcttttaataacaaatcgtccaaagatctcaaagtaagggttttttttttagcttccattcttccgcagacttggtcatcgacctatttttgttgaagaatgaaaggcaatgacaagtttaacataaacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgc

SEQ ID NO: 5934 - DNA, 606 bp, Homo sapiens
attgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggaggagagctcgcctggccaccgggccacggccccacagacccagcacgtatctcccatgcgccaagtggagccccccggccaagaagccagccacaccagcagaggatgacgaggatgatgacattgacctgtttggcagtgacgatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggagga

SEQ ID NO: 5935 - DNA, 594 bp, Homo sapiens
atagtacgtggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaaggatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagc

SEQ ID NO: 5936 - DNA, 617 bp, Homo sapiens
ccggggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactg

SEQ ID NO: 5937 - DNA, 570 bp, Homo sapiens; identical to SEQ ID NO: 1481

SEQ ID NO: 5938 - DNA, 480 bp, Homo sapiens
tacctgagtggcatgcctgaatgcaagtttgggatgaatgacaagattgttattgaaaagcagggcaaaggcacagctgatgaaacaagcaagagcgggaagcaatcaattgccattgatgagtgcggactaactacgttgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaagggggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgc

SEQ ID NO: 5939 - DNA, 625 bp, Homo sapiens
ccaggggccttcgaggtgccttaggccgcttgccatgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcgttttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatt

SEQ ID NO: 5940 - DNA, 589 bp, Homo sapiens
gcctgtgatcccagctactcaggaggctgaggctggagaatcggttgaatcagggaggttgaggctgcagtgagccgtgatcctgccactgtactccagcctgggtgataaaatgagaccctacctcaaaaaaaattcacaacaaaacaaaaaatatacaagcaatatcctgtacagtgctcactcttctttttcttgtgatgatgaaaaatgataaaccgtgtgtgcaaagagatgacgtgatgaagcgggacagctcaggatttcatcacactactctgaaaggcacataatttaaaacttatgaattgtttatttctggaattttctatttaatatttttgaaccatagttgaccacaggtaactgaaaccacagaaagcaaaaccacagataagtagggactactgtaaaaagagaaatagttccataactttcaatgttaacttttttagccccaaagtttagaagattcagaggagaaagattttcccagtcaaaaagcttctgcccaaactcagacttttcagatatcttgttgaaggcaaatttccatgttatttcaatggcaaatggcagacccttggac

SEQ ID NO: 5941 - DNA, 581 bp, Homo sapiens
tacggccgggatgggaggatcacttgagcccagaagtttgagaccagcctgggcaacatagtgagaccccgtctctgtaaataattttaaaattagctgagtgctggtacatgcctgtagtcccagctgcccaggaggctaaggcaggagcattgctagagcccaggagtttgaggctgcagtgagccgtgatcacaacactgcagtacagcctgagtgacagagtgagcactggcaaattttaaaattttctgtaaagactcactatgttgcccaggctagccttgaactcctggcctcaagcagtcctcccatattggcctctcaaggcgctgggattacaggtatgagctactgtgctggccaagagagaatttttcttattcacaaataatgttcacagtaagaatttacttaaaatttttttaaagtaaaaagaactggctgggcacagtggctcacgcctgtaaatcccagcactttgggaagccaaggtgggtggatcacttgaggccaggagtttaagaccagcctggccaacattgcaaaagcccatctctactaaaaatacaaaattagcc

SEQ ID NO: 5942 - DNA, 80 bp, Homo sapiens; identical to SEQ ID NO: 1484

SEQ ID NO: 5943 - DNA, 644 bp, Homo sapiens
atagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcagaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgat

SEQ ID NO: 5944 - DNA, 530 bp, Homo sapiens
gaggaccgcctgtgccacggaggcggaggttgcagtgagccgagatcttgccactgcactccagcctgagcaacagagagatcccgtctcaaacaaaacaaaacaaaaccaacaaaatattctttatatggcatgttaaattctgcagagaaagtacaagaaagaaaatgagagaaaaaaggagaattatagatattcagaaaacagatcaatccaaaaacaaattttaatgaaaaagtagatcaccaattataaaatcctccatgtatctcaaacctttagtgactatcgcaggaaagccatgctatttacaagtgattgaatttcaataaagctgccgtatcatttgcaggatcttcactctcaaatttacaactatgtgaagtgggcatatgactcaatgagactaacaggcttcaaaattcagtaagttcaaaatcatgtttcggtatgacagcaatgtctctttctctgcctttacagaataaatctttaatagtaattgacttaggtctggggcggaggctcat

SEQ ID NO: 5945 - DNA, 497 bp, Homo sapiens
ggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagaaaactgggagagtacggtttccatgaatataca

SEQ ID NO: 5946 - DNA, 611 bp, Homo sapiens
  misc_feature 41: n = A,T,C or G
gtgccactgcactccagcctgggcgacacggcgagctccgntctcgaaaaaacaaaacaaaacaaaacaaaaaacgaggatatcttttcaaagcagatacaattaaaggaaaattctctagggatagttcaagttgctgtgatggctttatctgctaaaattttagttaagctagcagataatttatgagcaagttcatgatacatggaattcaggttatgtgtagactgaaagctctctgggctgacacctctctgggcagacaccacattattcctgtatctgcagctcttaggacagtggttaacacataattggtattcaataaatgctttttcactgaatgaatgaatttttagtgaataaagaataaataaagtgttgaagtagcccaaaggactttaaaatttacattttctttttctgtagatcacttgataggtacattgttggatgtaattaaaataagacgggctctatatgtctacgaataggacagtagttaataaacaatgatgcatttacacaaaggtataccatgaatctatacaaaggaatgaagatttcgtgtgtctgtatgtatgactatatggtgattatataaagaaaag

SEQ ID NO: 5947 - DNA, 606 bp, Homo sapiens
agctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtattttttttgctgtggacacagcctacgcggccaagaagctagggctgctagtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagccagcgctggtgtgggt

SEQ ID NO: 5948 - DNA, 552 bp, Homo sapiens
ccacctctaagtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggcgcaaaagatcctgcaggactacaaatccctccagggtatcattgccatcctgggtatggatga

SEQ ID NO: 5949 - DNA, 300 bp, Homo sapiens
gaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagctcataatgaaatct

SEQ ID NO: 5950 - DNA, 606 bp, Homo sapiens
tggttgttggctctgaatttgcttgctgaagacacatattttgggtatactgtaaaaatgttgaaaaaatacagaggagctcctgggggccgtattctgtatttaccttgtgatttaggtttgcttgaaataccctcataaacataaatagtgatatatgctttaatgtttttatgtttaggaaagaggtgaaattagattctgagaatacttttaccaggaaaaattccccaaacatatataagtttttccttaccttttctagtacattcacaaccttcttcatctgcactgggatggtgatctggaaatgtgaatcatagaaaatggcaggcaatagaggtgtgactggcatacgcactgtcaaaattactaaacctgtgttgtctgggacatctaagatggaatcaagttacataaagtttagttaaattcaggaaggatttgttcacctctatgcattagatgtcatattgaaatagtatgtgaaaaggaaaatcttgcctggactcacaatttttatttactgttataatgtcatctatgctgttcaattatagtattatttgaaaggaatacatgaaaaaaaaataggcacagtttgta

SEQ ID NO: 5951 - DNA, 589 bp, Homo sapiens
cgaggcggcggtcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcctacctcaaccccttcaacaagcagtctgggccgagacagcatgagcagggccctggggaggaggtcccggacatcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccgcctccggctgaagctccaggagctaaaggaccccaatgaggatgagccaaacatccgagtgctccttgagcaccgcttttacaggagaagacaagagcgtcaagcagacctgtgacagtgtaacac

SEQ ID NO: 5952 - DNA, 598 bp, Homo sapiens
acatacattgatagggtcagcaaattcccaaaatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgctta

SEQ ID NO: 5953 - DNA, 643 bp, Homo sapiens
ccggggttgagtttattactagtaccacaaacctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggagacataagaggaggccaaaagttaaacgttctaagaagaggcgaaaggaagcaagcagttcaggagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaag

SEQ ID NO: 5954 - DNA, 567 bp, Homo sapiens
ccacaccaccatacagcctgtcaaatttgagggataactaaagagactctctacaaaggaataacagctggattacagctcacgcctgtaatcccagcactctgggaggccgaggcaggccatttgagtcaggagttcgagaccagcctggccaatatggcgaaaccccatctctacaaaaaaatacaaaaattagcaaaaaaatataaaaattagaactcatcaccagcaagcccgcactacatggttaaaggatggccttcagaaggaaccagatggaaatatggatctaaagaggaatgaagagcactggagatgcttcttcctatggaaaaaaggaattggaaggaggcagtaaatgaggccacatggataagaaagaaagggagagagagaagtatcaatgccttttgtagtgacagcatctctgtttaagggcttagacgcgaagtccaagattctggtttgaacggacaatcatttctcacgaaacctatctaagttatgctttagatcaactctttagagactgatttcttttttctctttttttttaaaaaaaaaact

SEQ ID NO: 5955 - DNA, 520 bp, Homo sapiens
gagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattcta

SEQ ID NO: 5956 - DNA, 268 bp, Homo sapiens
cacatttgctcctatctttcgcctccttaggatcgctcaggcccctctgtgtccactgtaactttcccagagtcggtcccaaagctcactggaccctctagatgttccctgtggccctgggggctccatggtcaaatatgtgagtgtcacatcctgtattttatggtgagtcacatgttacaccagtgcacaataggctctgacgtttcctgcaataaagaggtctgttgaactgggcccaatccggcatttttcatgcttacttgac

SEQ ID NO: 5957 - DNA, 585 bp, Homo sapiens; identical to SEQ ID NO: 1492

SEQ ID NO: 5958 - DNA, 612 bp, Homo sapiens
agcaagcaggaagtgaactgagggccaccctgggaggaagccgactaggcgaattcacttactgaccggcctgggctgctctgagacatggaggaagccagtgaaggtggaggaaatgatcgtgcgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggagcctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggt

SEQ ID NO: 5959 - DNA, 580 bp, Homo sapiens; identical to SEQ ID NO: 1493

SEQ ID NO: 5960 - DNA, 614 bp, Homo sapiens
ttgttttgtttttatttttaaatgaagtttccatctgtacacgttaagaaaataaacaaaacaacaggaagccattctctgtgtatcctccttggaggcaggaaggatggatctgccgataggcacacaacagcacacagccagggctcatgggagtgagtgcccgtcacctcacgaaggtcatgggcctaaaacatacggaggctccatagaaaatgctccagctggctttgcagtcatgcataaaggtgaggacacttaattcaaggcatctgggggctggtgtcaccgcacatgaagagtagtgcccatgctgtcccacgagcttccttgggaaaagggaaaaacaaatcttttcctcaaatagaattgtcgcaggaaagagccatgacattttattcactgtttaatcatcgggtggcaggatttctttgaagtagaatctgcatataaataaaaatgaggcagcaaattggttacaaggcttcacagattttttgaaaagaattccacaattttgaaacactatcactgaattcatgtaaattttggtaaaaatatgaattatacagtggtttaaattatgatatttaagaaacactgaacaaattata

SEQ ID NO: 5961 - DNA, 577 bp, Homo sapiens; identical to SEQ ID NO: 1494

SEQ ID NO: 5962 - DNA, 127 bp, Homo sapiens
tgaaggcctttgtggtctgataccaacccctgtgtcccaattataaattctccttttcttctttacctaggttaaagtgttggattcataattctcacttcaggaagactgaaaaccagactttatt

SEQ ID NO: 5963 - DNA, 386 bp, Homo sapiens
tacacacattatattatatatatgtatatacacaccttatattgtatatatataaatcaatgcgtacgtgccttatatacatgtgtatatgtgtgtatgtatgtgtgtgtatatatatatatagagagagagagagtgagagagatttgtaatcatttctcttctctctcatatgctaccaccgcgctgataagcccacaggaaaaacaatggagaggggtgtgtgaaagagtggaagagctgaaagacacacactgtccttgaggagaagtacaaaagcacgcccccaaagcccagaggagatgaaatacacacacccatcattgggaatttaaaaatcctgtgctaaaagttaccaaaacaaaacataaacaaaaaaaaattaa

SEQ ID NO: 5964 - DNA, 489 bp, Homo sapiens
gactgtgcatgatgtttattagtgatgacagtgaggtgaggcaggggcttgtggagcatgctctgtaggtcacacactaaagccataaggcaagagtagccggggagacaggtcctctgtgccctgtctctccccatctaaccctaacctaacaagcggcagctatgagtcagggaacaaagtctggagcccggttctccaaagatgtatgagggacaagaacagaaatgacaggatgcagggcaaaagaatgagaaaggcaaggaggcccccctaagttctctgctacacatgccctccttccccaaacccccatccaggttggctcccatctgccacttggcttcaccatgctcctggtccctggtcctgtcacatgttaagaagcttcctggcagggtgaggagagcccttccctccaagagcttcagctgtgagctctctctggcccgagcgtggccagcctgctgctccagtcttggatgtggc

SEQ ID NO: 5965 - DNA, 797 bp, Homo sapiens
  misc_feature 431, 462, 476, 783: n = A,T,C or G
cagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgccgaatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcanggctgcacaggcatgccgtatctctcctctntgtcacaacctctntgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcaggaaaatggctacgagtataagaagattccagatgcaacccctctgcttgatgccagctcactggagtatctggttgctcagggacagtatgatttggtgaaatgcctggcttctattggagacccccagaccgagcangatggacatgatat

SEQ ID NO: 5966 - DNA, 487 bp, Homo sapiens; identical to SEQ ID NO: 1497

SEQ ID NO: 5967 - DNA, 489 bp, Homo sapiens
ttttttttttttttttttttttggtctgggaactttaatactgtgacaaagttctctaaaataggcaccttccccaccgtacctcatcgcccagggcaggcaggcagggcaggctagatctcgtaccgatacttgagcacgcctcctcctggtgcagaaagaaacctcttctgtaccgaaatacaagcagcagctgtggcctgggccaccaggtggagcatggggaacactctgggccctgggaggacgaagccagtgccactaggagcagactggctggggacggttgtccacacagactctggccccatctgggtgggcttgcagcaggcgtcctgggccagaggaggggccctggcatctatccaacaccaggacctctctttaggcctaggccaaactcttcagaagtcacgacacacagatgtgggccccggtcacgcctcatgagctgtctctgggaagaaaatctcccggcatcgctgcacc

SEQ ID NO: 5968 - DNA, 555 bp, Homo sapiens; identical to SEQ ID NO: 1502

SEQ ID NO: 5969 - DNA, 573 bp, Homo sapiens
cagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgcttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccaaaagtggacacagagggccctgccttcctgtcggatgtagaggagaatcaccaagaatgcaaaccccacact

SEQ ID NO: 5970 - DNA, 506 bp, Homo sapiens
ggaggaggagccgtgtgccctggcactgagcggccgcggccatggcgtacgcctatctcttcaagtacatcataatcggcgacacaggtgttggtaaatcatgcttattgctacagtttacagacaagaagtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatctccatggaaacgtctgctaagactgcttccaat

SEQ ID NO: 5971 - DNA, 528 bp, Homo sapiens
tttttttttttttttttttttttttgggggggacaggaagtagaatttattggtgagtattaagaggggggcagcacattggaagccctcatgagtgcagggcccgccacttgtccagagggccacgactggggatgtacttgaccccacagccatctgggatgagccgcttttcagccaccatgtcttcaaattcatcagcattgaacttggtgaagccccacttctttgagatgtggatcttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagcctgtcagccccagcacaggacaacatcttgttgatgcggatgacgtggaaggggtggagccgcacccggatatggaagccatctttgccgcaactttttaccatgtacttattggcacaaattc

SEQ ID NO: 5972 - DNA, 411 bp, Homo sapiens
tttttttttttttttttttttcagaattctttaatgacatgatgttgagcatcttttcatatgcatatacatatgggtgaggtgtacgttcagagcttttgcccgcttttaatcaagttgtacatcttcatattgttgcattttaagagggtttttttttttggtatattttgggtcgcagtgctttatcagatatgtcttttgcaaatattttctcccagtctgtggctcgtgttgtgaacgtggctagttctcttgacatacatatcttttcccagtatgtaatcctgttgtgctttttttttttcctttagagacggaatcttgctcttgtcacccaggctggagtgcagtggcgcgatctcggctcactacaatctccacctcccaggttcaagggattctcctgcc

SEQ ID NO: 5973 - DNA, 513 bp, Homo sapiens
tttttttttttttttttttttagaggagaagagggaacaataataaaaatttcaggccacacgttgatgtccaaagatgctacaatatgtatctagaaaagtttccacattaaactgtatttcagtgtggccaggtttctaggcccactgcatttacatacttttcatgaacttagacataccataattttttgtgttttaccaaaatttgcctataaattaggtgctaatttatgtatcttcacacattacaggataatcctgagcatcacaaccctttccaactttcataattagagtatttgaaaggttagctttccaattatttttcccagttaaaattcatatttccatctccattttcttttctctcttaaggattcttgattttattctccagctcggaaatgccgagcactttgatttcccatgagatgcttttggaaactactttaatatccagattttatgatctgtaattttctaggttcataagaaaaacaaaggactatt

SEQ ID NO: 5974 - DNA, 622 bp, Homo sapiens
tttttttttttttttttttttttttcgccagggatattggtctaaaattctcttttttttgttgtgtttctgccaggctttggtatcaggatgatgctggcctcataaaatgagttagggaggattccctctttttctattaattgccttccaaccttgttataattatgccaaaagtcaaacttatttgacagaaccacaattctttgacagaactaaaaaaatcctcatagtagaattagattggaaacaaagattacacccagtaatcttttcccccccacaagacggagtcttgctctgttgcccaggctggagtacagtggcgtgatctcagctcgccgcaacctccgcctcccaggttcaagcgattctcctgcctcagcctcccaagtagctgggattaaaggcacccaccaccacacccagctaatttttgtattttttagtagagacagtgctttaccatgttggccaggctggtctggaactcctaacctcgtgatccacccaccttggcctcccaaagtgctgggattacaggtgtgagccattgtgcctggcccacccaataatcttaactgatcctcatcactttacacacacaacttttttttttttt

SEQ ID NO: 5975 - DNA, 448 bp, Homo sapiens
tagcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcggatcactttccagttggatgtatgaaagttggcacttctttttccatcccggttgtcagtgatgtgcgtgagctggtgc

SEQ ID NO: 5976 - DNA, 558 bp, Homo sapiens
accttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttaatttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttatt

SEQ ID NO: 5977 - DNA, 481 bp, Homo sapiens; identical to SEQ ID NO: 1508

SEQ ID NO: 5978 - DNA, 605 bp, Homo sapiens
gttctaggtgtcatggctgccccaagagtctaggtaagagtttgttcccgtggtgcggagggtcaaggcccacacccggaaacccagcgaggtaaagttgcgtcttggttgtagagacgacaacttctccgcttcctcggcgatggcggcgtccgggagcggtatggcccagaaaacctgggaactggccaacaacatgcaggaagctcagggtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactc

SEQ ID NO: 5979 - DNA, 326 bp, Homo sapiens
tttaatgttttctgttataatgaataatatgtcaataaatttgggttcaagaaactaacaggatttcaggagggcaacggggaagataagcctgcaatgaacagctagctgtgttcctcccttacgtcggatagaaaagagggagaactattactgaaaaaaattaagaaggaagaaatatcaacatcaattttaaatgcatcacagcctcagattcggcgcagtgattatccttttttaaaaggatatgtacagtagcaactgctctttaataccatctctcaagccaagtcaacactagtttgaagaatctcctggtatgtcat

SEQ ID NO: 5980 - DNA, 637 bp, Homo sapiens
atcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacctgggtagaagaggagcaaaaatacctctgttttctcttgccaaagtaagatgaagctattccaggttgagggattcttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattccttattcaattttactgaagtactggctctttcctgctctggacaagaattgagcaacttgtctgatgact

SEQ ID NO: 5981 - DNA, 421 bp, Homo sapiens
agtgactgtgggtctggaatggctggtgtacttgggaatgcactatcaggattttacagcaatgctgggaaatgacagggaaaatgacaggaatgaatctcaccagattttttatgtacgcggcagagccttgagttactgtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtc

SEQ ID NO: 5982 - DNA, 578 bp, Homo sapiens
cgccgcgtccgcaggaagaggcgcggggtgcaggcttgtaaacatataacataaaaatggcttccaaaagagctctggtcatcctggctagaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaaagagggaccatatgatgtggtggttctaccaggaggtaatctgggcgcatagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatgg

SEQ ID NO: 5983 - DNA, 571 bp, Homo sapiens
tctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgaaattcccagttcttactaaattgtattagcaggagctggtaattacttgtattatcacatgtaactaataatttgaactatacttgaaggaccgtgttgatgtcaggtatctacagcggttggaagatagcagtattattagcataagctgcatacgtaata

SEQ ID NO: 5984 - DNA, 575 bp, Homo sapiens; identical to SEQ ID NO: 1511

SEQ ID NO: 5985 - DNA, 535 bp, Homo sapiens
ggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataat

SEQ ID NO: 5986 - DNA, 561 bp, Homo sapiens; identical to SEQ ID NO: 1513

SEQ ID NO: 5987 - DNA, 537 bp, Homo sapiens
tacggccgggttcgggggctcagccttaatcccagcactttgggaggctgaggcgggtggatcacctgaggttgggagttcgagaacagcctgaaccaatgtggagaaaccccatctctacgaaaaatacaaaattagccgggcgtggtggtgcatgcctgtaatcccagctactcaggaggctgaggcaggagaatcgcttgaaccaggaggtggaggttgcggtgagccgagatcgcgccattgcactccagcctgggcagcaagggcaaaactccatctcaataaataaataaataaataaataaacaaacaaactgaggtgggagtggtaacacgtgcgtatagtcccagctactcaggaggctgagagaggaggatcagttgagtacagaagctggaggctgcagtgagctataactgcacacttcagcctgagcgacagggcaagaccctgcctccaaaaaataaaggcagattttacggccacaggcgcagccagacagcagttgcctgccaaatgagctcccttggcct

SEQ ID NO: 5988 - DNA, 592 bp, Homo sapiens; identical to SEQ ID NO: 1514

SEQ ID NO: 5989 - DNA, 609 bp, Homo sapiens
tacggccggcttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaacggggaggcttgcaagtaaaatcttaaaaccacctattttaaactgatgacaagttaactctgattacaaagaaaaggcaaaaatgcaaactagcacagagaaaactaagaaaactttacattgtatattattgcaaaattataaaacaagaaggaaatttgaaagctatttgaccatttacttttaattaagacctcttttatcaggttttaagtatcacatttggaagacgattttctccattattctgtttctccaataactcaattgactccaaaaatgatcatcagcagatgcctagatagtttataatcccatataaatactgaattcttctattacaagcttgaggggatattgcttgaaaattgctctatg

SEQ ID NO: 5990 - DNA, 609 bp, Homo sapiens
aggagaagcgcatcactgaggcagagaagaacgagcgtgtgcagcggcagctgctgacgctgagcagcgagctgtccctggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtatt

SEQ ID NO: 5991 - DNA, 564 bp, Homo sapiens; identical to SEQ ID NO: 1516

SEQ ID NO: 5992 - DNA, 569 bp, Homo sapiens
tctgctgagtccgcagcactcagactacgtgcacctctgcagcaggtgcaggcccagttgtcacccctccagaacatctccccacggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaaactggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatac

SEQ ID NO: 5993 - DNA, 496 bp, Homo sapiens
tacggccgggcagcagagccgagtggcacagatttcagctgtgcccctggataaaaggggtgatggcagccaacaacaccagctatggggactctttgccaccttcgccattctgggagtaagctctcagctacgctgtgagcagtcaaagcaccgattcactgagcccagattgtatccgtctctggctatgcagggaggatctattaagccccttagttctccaccgacgggtggggcaccacttcccactgagtggcatctaatggataatgggcattcccccagtaggaagatttggaagccgatcccaacacacacacacgcatgcacgcacacacacgcgcgcgcacacacacacacacatgcaagcacgtcagctgcagtcccagggaggcaaagacagttatcaaaaggagagggttttccagacaaatattccagaagcatattcccacaagaaaagaagagactgggcagacaaaacaatagtgtc

SEQ ID NO: 5994 - DNA, 694 bp, Homo sapiens; identical to SEQ ID NO: 1520
  misc_feature 108, 128: n = A,T,C or G

SEQ ID NO: 5995 - DNA, 660 bp, Homo sapiens
tgttttatgctgaatgacttggctatccaaagcttctagtctagaggtctgttggttgaagcagactttccagtttgttgaaataatacgaagctgactagcttacgtgaatgatgttgccctcatttgttttgggtgaggactcattactgcagtatattgatctcttcaccaaatgctttttctttttctgaataaatgctgtattagaggttctatttatatatgatttttaaaactttggtttccttctatccaccaaatactgtgaattgtttttccatttatttttcttagctaatgtaactttattcttcacttttttttagccctagacttcctagatttttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaattt

SEQ ID NO: 5996 - DNA, 647 bp, Homo sapiens
tggaaacatgcggctgtcggtcgctgcagcgatctccctggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagttcccaaatcggagtttggatcgggccaagatggcagtgatcgagtataaagggaactgcctcccacccctgcctctgcctcgcagagacagccaccttacactcctaaaccagctgctgcagggtgtgcggcaggacctcaggcaaagccaggaagcaagcaaccacagctcccacacagctcaaacaccagggatttaactggatctgaagagcctgcagcccttaatcagtacccatgatcacaggcctttggagcacttttactctctgagaagaactggagctagagatgtaaaatggacagtcttgat

SEQ ID NO: 5997 - DNA, 468 bp, Homo sapiens
tggttaaccctgcagaagtaacttctgtaaatatcatcagcagggcacattttctggtgaacgagccttcgttggttaaccctgcagaaagtaacttctgcttctggctgcacccacctctccactgtttccaaacagatattctccaaattagctccttttgggattcctacatctgctttatctacccagagctgtaccaagaagaaatctcaacccccaaaactctggggactccctgtctgcgaacctagtccaataattctgaacacacttggcagcttttacagggactaggcacagaatcctccctaatcctggaccactgagggcctctcccactccattcctgcctgtagaagctgagttctcaccaactgcctgctccctgctgtcctgccacacatgacagcttcattgtccactgttgctgccggaaaataaccgttttccttaaatatctgcatc

SEQ ID NO: 5998 - DNA, 555 bp, Homo sapiens; identical to SEQ ID NO: 1523
  misc_feature 487: n = A,T,C or G

SEQ ID NO: 5999 - DNA, 562 bp, Homo sapiens; identical to SEQ ID NO: 1524

SEQ ID NO: 6000 - DNA, 641 bp, Homo sapiens
gctttacccagtcacccgcagggtggccgacgggcgaagaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcagaacttgtaaggaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttacatccttggctccttccaaaaatcaagatggcaagaactgccatttgcaacctaatctt

SEQ ID NO: 6001 - DNA, 584 bp, Homo sapiens
acgagctcatcagccgcaggccattcaccatccctcagtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccagcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagacacacggtgccttatgccacagccgaagat

SEQ ID NO: 6002 - DNA, 496 bp, Homo sapiens
cggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccagttggaagca

SEQ ID NO: 6003 - DNA, 608 bp, Homo sapiens
ttgccagcttctctgattgcccctttggatatccagggtgagctagcaacaggagggcatatttcattgccgattttgactgtaagtgcactctctgggcagacaaatcaatctgagagctggcaaccctcgggtaggatggtcactcacagcggcagtatttttcacctttccctttagagatcctggtgtaacaaaaaacgactgggtagagtatcagaagacctggctggcaggcaccagcctgaccccttacttcagggtggcctggggcagtgacaagacctctcttctccttattcttttcatctgtaaaatgtgaatcttttacagataagaacctttgtgccttttaatgggcacaagcccttcactgaattttgcatagagctgggatgaaacccaaaattgtggtttaaagcccactaaagaccatgcaactgaggctggcagagatgtggagaagaatctgggttttccaactccaactccaataccctttccactgcaaaaagcataaaaacgctcgtagtttccttgcctgacaagcctgtgttgagtttcgaaagcatgtgaaagcaggttgagcaggacagagctatggcatg

SEQ ID NO: 6004 - DNA, 445 bp, Homo sapiens; identical to SEQ ID NO: 1527

SEQ ID NO: 6005 - DNA, 565 bp, Homo sapiens
tggtcccagtgtccagccaccgcaaccccctgctggacctggctgcttacgaccaggagggccgccggttcgacaacttcagctctctgagcatccagtgggagtccaccaggtcagtgttggccagcatcgaggctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccacaccgcagatgttgtcaaggtggcctaccaggaggccaggggtgtcgccatgcgtttgatgttggtctccagctgtcttgcaagaggatgctttctcagcgccgtgcct

SEQ ID NO: 6006 - DNA, 475 bp, Homo sapiens
ggcaggcaaactcacttgtaacccgggaggtggaggttgcagtgagcccagaatgtgtcattgcattccaacctgggtaaccaagcgcgactctgtcaaaaaaaacaaacaaaaagcaatatactgggtaatcgatgacagcataattcactattatgtagatcggagagcagaggattctgaatgcatgatcatatcattaacatttcaatacattactcataattactgatgaactaaagagaagccaagaaattatggtgatagttatattgacctggagaaatgtaaacccaaaagaaccgtacgatgagaaatgtgctaacacagtctataagggcatgcatgaataaaaataggggataaaacaggaaagtttttcaaaagctttctgtgcatgtaagtcaacttgtatcggttaatttttaaaaggttaatttacatgcaataaactgcacatacttcaatagcacat

SEQ ID NO: 6007 - DNA, 565 bp, Homo sapiens
tccggcagaagaaacatcacggaagcgcaagcgagacagcggcgccggctcctccaccccgaccaccagcacccgcagccgcgacaaggacgacgagagtaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtcc

SEQ ID NO: 6008 - DNA, 613 bp, Homo sapiens
  misc_feature 432: n = A,T,C or G
tacggccgggcaccattgttatattagcaattcctggacttcatgaacagagcactcgttattctgcaattaaatgaaaataatggcatcgcttagctataaggaaggaaacgttcaagtgcagcctctgtataattaagcttaacattattatcaacagaaagtgattgtagttgtgttcagaggtgagaagagatatgccaccaaccatttgacctatcaaaagaaaatggcttttgtgatgtttgatgttcttcctaacaaccagctttgtgccttgcatggggcaggtgccattttctgcaccattttctctcttttccagctgttttaaagttctttctcatcagttctcatgactgcctttgtaacacttgtctgttttccatttttccttatgtcttcaccagcatctgttgtcctgctttttgntttatctttttctttctttggcgacaatctattttcttgactcagacacactggctttctgacataaaattaaaacaatccatttaatttttaactaaaacaggtgttgagtgattgaccctatcaagcagctccctacagaaacactcatttttatgctgttccctcttgggcttcatgc

SEQ ID NO: 6009 - DNA, 583 bp, Homo sapiens; identical to SEQ ID NO: 1532

SEQ ID NO: 6010 - DNA, 240 bp, Homo sapiens
gccccaggggctggcacctgatgactgttcctttccccgcgacaggtgtagccttcacagacctcccggtgagtactactattgagtcttcccctcctgggtttctgggggctgactgggatggggcacggtggtacctgcaagcgcagggtgtggagtctggttctttacccaaccaaggatgagcgccatgctgacagcttgagggtaccaggaggggcacttgttggccttcctctc

SEQ ID NO: 6011 - DNA, 480 bp, Homo sapiens
gggcaaaccatgaggttaggagttcgagaccagcctggcaaacatggtgaaaccccatctctactaaaaatacaaaaaaattagccaggtgtggtagcacatgcctgtaatccccgttactcaggaggctgaggccagagaattgcttgaacccaggaggtagaggttgcaatgagctgagatcgcgccactgcactccagcctgggcgacagagcaagactcagtttcaaaaaaaaaaggaaaatggaagccccctacattggaccaaaggaagtctgcagcttttacattaagcagactttacactcaattaggttcacctagtctgtttttcttctcatcttgggaaactagccatttccagacatctcttcgtccatataattgaagaaactaatgtctaataggtaaaaccctgtttctgtaatctcaggtgtaaattcaagccaagcagcctagggtatatataatttctcaaa

SEQ ID NO: 6012 - DNA, 465 bp, Homo sapiens
gcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagagtttggaactgaaacatgaagaggaagacagaaataagaatttgggaacctgaatagctctgcaaaaaaacaccaaaggaccgttttatcgttttctgttgttgctgtggtggagtgatgc

SEQ ID NO: 6013 - DNA, 508 bp, Homo sapiens
atgctaagccatgaccagtgaggagaagcaacagagcctgtctgtccccatgagcggagtctgtcctctgctcttctgcagtcaggtcacagcctactgcctgggggctctagtcattccagtggaagacgaatgtagcctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccct

SEQ ID NO: 6014 - DNA, 573 bp, Homo sapiens
ctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattctagctggtgtcagcccctcttcccttcctccattgcacatgaacatatgtccatccatatatattcatcagaatgttaatttattttgctccctctgttaggtccattttctaagggtagaagaggcaagtggtacggatgaggtctgataagaacccacggtggagagggagactcctgggcagccgttttcctcatcctttccctctcccagtccatttgcaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttct

SEQ ID NO: 6015 - DNA, 63 bp, Homo sapiens
tctcaaaataataaataataaaatagactcaaaattagcactatatacatacattttttaaag

SEQ ID NO: 6016 - DNA, 405 bp, Homo sapiens
gagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagt

SEQ ID NO: 6017 - DNA, 574 bp, Homo sapiens
tttttttttttttttttttttttccttgaataatcattttattaacaaatacaaacttgaaatgttggtgataaaatatatcaatattgaacaaaaatgtgtgtaaacagtaattctacaactgggaacatatcccagttttgttaattttggtgacgtcttcccaaccatgtctgatcttcagtatcttcttcctcaagcatggcaggaatagtatgcttttaaatatcaggacaacaattggaaggaaaacagctatcataaaagttggaggtgtataccatacaaattgttttatatctatccacttattccaggcaaaaatcaatgcgtgtattgtgcccagtagaagggaaacaattcctagcttgctctgaatatagtgaaattctctccatgtcaaagagtcactcacagatggaatagatgtcacagccaacagagccagtattgccaatcccacaattcccagagacacataaatctccattctccaaacatcatgctcaatccaggcatcttctttattttgttggacctgttgatatgcccagtttagcaacttgtatctgta

SEQ ID NO: 6018 - DNA, 413 bp, Homo sapiens
tttttttttttttttttttttttggattaaaaaagtgtattggatttccaatactaaataaaaacatgaaatcgtttttaaaaagccatagagtttacggcatcaactacagaaaaggccaaacaagtgtgtacagacgccagtcccagcagccctctgggcccctcccacaggcagtgcggcgacagacacaggtgttccaagtccccccgaggaagctgctgagcggcagctcaaccaggacactacaggacacacaatggtttagttttgaaaatcacaggaaaatgtaagaaaatgtattaaattgtgaaaaggtgcaatacagaatagctttcctttttcttaattttttaaaaaacccccaactttgaacagctattttatttaaaaataggcccctcccccacccg

SEQ ID NO: 6019 - DNA, 359 bp, Homo sapiens
ttttttttttttttttttttttttccttcattaaaaattttaagttacaaacattttgattgatagtcagtcatggtggtgcacctagtccttactctgaaaccaaatatcctgccatctggggactttcaccagccctgtcggttatcttaccgcaacaccaaagaggaggctcagccttccccagttccctgagttcacattgattcaattctacagctcactagacctgcccaagacaggaccaatcaatgtcccgggagggcagagagggtggtggggccacacttacccatatggaaagacagtattctcagatgagggcaggacttttttgtgggagaggacgcctagctttc

SEQ ID NO: 6020 - DNA, 356 bp, Homo sapiens
tttttttttttttttttttttttctcaatgagaatctcctgcacctaaatagctctgcatcaacctgcctctgtgcctcagattccaccattagtcagtcctctgaataaaggccttatatttctcaaaggtccttgctaaaatacgagcacataactgaggagattctcattgaggaaaaaaaatctgcttgtcaccatggagaacagaggatcagggcctaaaatgagtgctacacaagatggggacattttgatcagggaaagatgagaagagggatgtccattctgtgggctgctgtcctgggagggaggacctgaggagctgtatgagagaattaggaatttaggggaagc

SEQ ID NO: 6021 - DNA, 457 bp, Homo sapiens
ttttctttgttttttttttttttttaggagagatgaagttttgccgttttaactaggctggtctcaaactcctggcctcaggtgatctgcccacctcggactcccaaagtgctgggattacgcatgagccatcgcgcccggcctgcaatttgcttttaaagactttagcaaagaaataaaaaaggataaagtgaatgtggcatattctggaccactgctgaacctgcgtgagggatatacagttcattatgctattctctccacttctgtgtatatttcaatatttttataataaaaaattaacgccaaatttaattcctttatggagaattattttcttgttcagttttgttttttcttggcatttctatgcttggaattttctttctctgtagcacacaaaaatgtttcagcatatcttgaaaacttattctgcttctcaatgatatgcttgaac

SEQ ID NO: 6022 - DNA, 459 bp, Homo sapiens
gacataagaaaaacatagaaacataaaaacataagaaaaactattatttgttgtgatttgttctccctaatctatgaagtcggtagggtatctgtcataaagattcccctctagagtcgagaaaacagaggctcagagaggttaagtgtttttctcagggtcacacagcaaatacagaactccagtcttcttgctgtgtctcttaccctctgtcatcaggatgcaggggctgctgagctgagatgcctgcagatgagtaaactggcgggaagaaagacaccaacccaatagatctccatgtattttatatattttctcacctactcagtctagattttcaaacaacatacagaactttctgggatcttgtcatcattcagtgtactgtcctctggatcctctccaggagccgcccactccgcacacattttttttttctagttgtcataaacaaatttc

SEQ ID NO: 6023 - DNA, 62 bp, Homo sapiens
ttttttttttttttttttttttttttttgggattgagtccctccctgttgtccaggctggag

SEQ ID NO: 6024 - DNA, 551 bp, Homo sapiens
tttttttttttttttttttttgggacagggtttcactctgtcacccaggctggagtatagagtacagtggcaatcatagctcactgcaagcttcaacctcccaggctcagatgatcctcccaactcagcctcctgggtagctgggaccccagccatgtgccactgcatctggctaattttttaatcttttgtacacatggggttttgccatgttgccctggctggtctcaaactcctgggctcaaacaatcctcccacctcagcctcccaaagtgctgggattacaggggtgagccaccacacccggccccagctattttcattagaccatgaactccatgaggatggaaatgccctggtctgctcactagtataaatacaataccctgtatggtgccaatacaatagtataggttttcaataaatgtgtttattaaataaataaataacatgttggtagcctgataaaatttaatttcaagctaaatcgctttaaatggttatgaagatagaaagtaaaaacaaaaaaaccccatcaaaggtcaaattca

SEQ ID NO: 6025 - DNA, 557 bp, Homo sapiens
tttttttttttttttttttttggatagggacggggtctcgccatgttgcccaggctggtctcaaactcctggcaacaaagcaaacctgcttctgcctcccaaagtgctgggattacaggcatgatcccatgcctgtatacttataccacacctggccagtataagtattcattaagcttactattttatagactttataaaatcaatattttcacaacttcgtagttaaggagaaaactaggaacttggcttttcaaaatactttgtgttgcagtagtcgctgaatgttcatctatatcatttaattgggtatgcacctcaagaggaacatctgcttgaagaaaaaggaacgttctaagcactttctatacttgcaaaggcttcagaaatgttcactgttgctggttccatcacttactcctcatgcatatcatgattatcattgttgccttcttcatcgctatcaccacggctttctggttcaatttttacatcagttagcactcctgtagcaacttcaggatttggtaacttgggaaatagttaaattgctatct

SEQ ID NO: 6026 - DNA, 551 bp, Homo sapiens
tagagatggggtttcaccacgttggccaggctcgtctggaactcctgacatcaggtgatccgcccacctcggcctcccaaatttgggattacaggcatgagccaccgcgcccaacctcacactttttaaaaaaagagatgtgccattttgaataggggacagtcaaattttctgaataaatgtcttggaaaagactggtgatatgtgaggcttctaaattccctttctcttggcacaggcaactaaagtaaatatggaaaaagcttctgtatagcaatggaaacaatcaacaaagtaaggagacaacccacagaatggtagaaaatatgtgcaaactacccatctgacaagggattaataaccagaatatataaggagcttaaacaattcattagggaaaaatctaatactctgattaaaaatgggcaaaagatctgaatagacatttcttaaaagaaaacacacaaattgcaaacaggtatataaaaaggtgctcaacatcattatcatcagagaaatgcaaatcaaaactatgacatattgtctcgccc

SEQ ID NO: 6027 - DNA, 554 bp, Homo sapiens; identical to SEQ ID NO: 1548

SEQ ID NO: 6028 - DNA, 606 bp, Homo sapiens
agatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaatctggacattgaacgtcccacgtacaccaacctcaatcgcctgatcgggcagatcgtgtcctccatcacggcctccctgcgatttgatggggccccgaatggggacttgacggaattccagaccaacctagtgccgtacccccgcatccacttccccctggccacctatgccccagtcatctc

SEQ ID NO: 6029 - DNA, 632 bp, Homo sapiens
gagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctg

SEQ ID NO: 6030 - DNA, 613 bp, Homo sapiens
tgctcctcaaaatagaaatgttgaaagagaaggaagttgacgtttaaaaaaagtagttgtgaaatagcagctgtttcttttagctctgatattcaataaaaataaaatttattttgcctttaattgtattttatttgcccatcatacataaaagtacttacattatatatgaaatattgtatatatcaggaacaagtgtaaagcttcatgaacaatttggagtgacttatagttttcttaatttaattatttttactttagtgtgctctaccagcagtttccactactatttaaaccttataaacatcttccagacattgaatatgactcttctgtttgtttaaccttgaattgtatctgtcttaggaatgaaaacaagattggtattttcataggaaaatttggtaatcttaattgcttggaatggactgtaattcaatttggaactttttttcagatatagtttgcccatataactatcctgtgttaaaaaacatgtggagtggggaggctgagcaggagaattgcttgaatccaggaggcggagtttgcagtgagccaagatcaccccactgcactccagcctggcgacagagcaagactccatatcgaa

SEQ ID NO: 6031 - DNA, 631 bp, Homo sapiens; identical to SEQ ID NO: 1551

SEQ ID NO: 6032 - DNA, 616 bp, Homo sapiens; identical to SEQ ID NO: 1552

SEQ ID NO: 6033 - DNA, 499 bp, Homo sapiens
tcacgggcaaggtcaacatcaagaaggaggagagaccccctgagaaggagaagagctccccggccaaggctgcgtcccccatagcaaaagagaataaagatttcccgaaaacggaggaagtcagcggcaaaccgcagaagaagggccctgaggccgagactgggaaggccaaaaaggagggaccgctggacgttcacaccccaaatggcacagagcctctcaaagcaaaggtcaccaatggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgactt

SEQ ID NO: 6034 - DNA, 377 bp, Homo sapiens
accacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcgcatccacagagcagagatctcaaagattatgcgagaatgtcaggaagaaagtttctggaagaaagctctgcctttttctcttgtaagcatgcttgtcacccagggactagtctaccaaggttatttggcagctaattctagatttggatcattgcccaaagttgcacttgctggtctcttgggatttggccttggaaaggtatcatac

SEQ ID NO: 6035 - DNA, 501 bp, Homo sapiens
gtgagcagctcctacccgatgcttggctcttgattctcagggtcgcggagaactggccgcgggcgtccggggccgggaacagaaagcgggacctgggggccatgggggatccggacagagaccgcgcttggacgtgcacgggcctggcgttcgctggtgctcagtatacggcgcggtgaggagcggcgagcacccggacgtcacctggcctggtagggaacggaacccggggcgcacaacgctatgggcggccctgccaggcctctgctccgagtacgggaaaccgcgattttaatgcggctcatcgcgaaagcttcgtcgttttgtctggctgtctttaacacttttgtgagaggaaaaattggcttgcaatacatctcgctggctgtttgcggctactatcagaagttgaattccaataattagctattttataaaggtaacgagaaaaaatacactatgtctgatgaagtttttagcaccactttggcatatacaaag

SEQ ID NO: 6036 - DNA, 507 bp, Homo sapiens
ggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtccctgttgctcaccccgcaggagaacgagtccctcttcactttcctcggcaagaaatgtgtgactatgtcttcagcagtggtgcagttatatgcagcagatcggaactgtatgtggtcaaagaagtgcagcggtgttgcttgtcttgttaaggacaatccacagagatcttattttttaagaatatttgacattaaggatgggaaactattgtgggaacaagagctatacaataac

SEQ ID NO: 6037 - DNA, 650 bp, Homo sapiens
tacggccgggcacggtggttcatgcctgtaatcccagcactgtcggaggctgaggtgggtggatcacttgaggtcaggagtttgtgaccagcctggccagcatggtgaaatcccgtctctaataaaaatacaaacatggtgaaaccccgtctctaataaaaatacaaaaaattagcctggcgtggtggtgcaagcctgtaatcccagctactcaggaggcagagtcaggagaattgcttgaacccaggagccagaggttgcagtgagccgagatggcaccattgcaccccagcctggacgacagggcaacactctgtctcaaaaacaaacaaacaaacagaaacaataaatacgtattagcaccttctatgtgcaggttttggggacagacagggtggctttgaatcccagcttcaccatttgtacatttgtagctgtgtggtttgtacaagtcctttaaagatgaacctctctgagcctcagttttctcttctgcaaattggtgctaatactttctattttccaggattactgtcaggattaaagaggacacaattcacgtggcacgtaatagccactcaaccctcatgccatgaccctccatggcagctttgtgggggagacacgggtcatcacccaggccagctcag

SEQ ID NO: 6038 - DNA, 545 bp, Homo sapiens
ctgatgaacagaccttctgcccgcatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagattagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatg

SEQ ID NO: 6039 - DNA, 572 bp, Homo sapiens
gagctggactcctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagct

SEQ ID NO: 6040 - DNA, 508 bp, Homo sapiens
atgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaaatgctgggcatcttggtgcagcacaaagtccggagtggcgtctcgggcaccgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggag

SEQ ID NO: 6041 - DNA, 464 bp, Homo sapiens
gttccttagaaaatctgttcaattttcctctatgatcaatgcatattaaaaccaatgtagagagctgaccagggacattgctttgttctactatatcacctttggggtagttaaatgaagtttttccaagtctgtgaaacaactaatcgtcattttttaaaacaattttactgtgttattattcctaaagtgtctctagaacttttctctttcaaggatagtggattgtggtaaggctaaatgtttaatgagtctctatgttaaagactgcacttatcttccaattaaccccaagaccactctggtatttttgtaaatccacagaagtattttgagtgaggcctaaagggtaagctgcaggcagcctgtgaaaagtgtaaaaagactaacctgctaacaaaccttgtgcaatgggacaaagaaagtttaatccgtattatggtaaatgcaggcttagtgtccca

SEQ ID NO: 6042 - DNA, 670 bp, Homo sapiens
tacggccgggactgaattgagagaatgaatgctctccacaatcaatgtcactaaaaaagcaactttctgaaataaaagagaactgtctacttttttctttgtcccttttttagcaagcagtttgcctctggtttaacaatatgaacatactttctttcccagctggagggatccgatcctaggaatattgatgtatgtgcaccccgtagattatacttttcagactagatggatttctaaatccaagatctaccaaatacttccacaattctaattaaaataagaagtttgggagtcagaaaccttttgccctagaggcttgccccaccatgtattaattttcaccattattccatttaactggggggactcatttttatttcctaaaaaaatctatatctggaaagaggtaccattctacagcatttctggcgaatcataaattaacctacagtaaatgacattaaggagatagctttgttctgtaaatggataggataccatatggctttgatgttagtgtgaagttaatcacaagctccataacaggccatgacatcatttcataataaattgcatgaacaaatgctgccgttatctgaacagcatgtgaattttggtacctataatctttagggaaaaatgaatataaaatattgagttaaaaaat

SEQ ID NO: 6043 - DNA, 455 bp, Homo sapiens
gggcggggtctgtagttagcggcgagagtgacaggaggacaggggttgtttcggcagtgacgcctggggagtgacgcaattgcacccctgtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatacactgtaaactgtgaaagccatcagtgtagtggaaggagcatagaatttagagtagagagacatggttttggaccctggttcctgctttccttgcttcatctgtgctgcctt

SEQ ID NO: 6044 - DNA, 246 bp, Homo sapiens
tatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagtttttttttttttcttttaaaacggagtttccttttgtcccccaggttgaattgcaggggcccaatt

SEQ ID NO: 6045 - DNA, 415 bp, Homo sapiens
cgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggag

SEQ ID NO: 6046 - DNA, 636 bp, Homo sapiens
tacggccgggaagcaagtgttaaagaagacttagaagaagccaaagcaataatatctaagaaacaagtggaagccggtgtccgtgttaccatggagatggtgaaagatgccttggaccagcttcgaggcgcggtgatgattgtttaccccatggggttgccaccgtatgatcccacccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggaacagaagcagctgatgctgtactatcacagaagacaagaggagctcaagagattggaagaaaatgatgatgatgcctatttaaactcaccatgggcggataacactgctttgagaagacattttcatggagtgaaagacataaagtggtgaccaagatgaagttcaccagctgatgacacttccaaagagattagctcacctttctcctaggcaattataatttaaaaaaaaaaaaaa

SEQ ID NO: 6047 - DNA, 625 bp, Homo sapiens
agacttttccagataaggaacaaatgcgggttacaggttgggattggtgggagaaatgtttacagaatgggtaattaggagtgggaaggtatgaggaagttgaccttaagaacaaagaacaaggaagttaaactttgaagagaaacccatcatacctaacagtcttgtaagaaaggatgacaaagtgattgaacattgggtggggctaattttccttggccaattcacttagtaagataaggagctccaaatcatatttaagttgggagtcaattgattttacttaattcttgtgaggttcagttataagattcatcatactactaccatgagccatcctcagctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctagcacagggaa

SEQ ID NO: 6048 - DNA, 524 bp, Homo sapiens; identical to SEQ ID NO: 1560

SEQ ID NO: 6049 - DNA, 353 bp, Homo sapiens; identical to SEQ ID NO: 1561

SEQ ID NO: 6050 - DNA, 640 bp, Homo sapiens
tttgttgaaaaaagaccagctttgtgaaggatgcacaggaacagtgtaacaagctgcggatgatgcattctaacatggagaccctctataaggagctgggcgagtacttcctctttgaccccaagaagttgtctgttgaagaatttttcatggatctttacaattttcggaatatgtttttgcaagcagtcaaggagaaccagaagcggcgggagacagaagaaaagatgaggcgagcaaaactggccaaggagaaggcagagaaggagcggctagagaagcagcagaagagagagcaactcatagatatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatacttgaggaagccaaggagttggttggccgtgcaagctaatgtgggtcctgtgaccgcggcagctcctcagcggagccgcagactgtcctgccctgcagcatgtgcctaaaggctca

SEQ ID NO: 6051 - DNA, 451 bp, Homo sapiens
tggggcagttatgggaatggtccctccctgggttcctgtccctcacccactgccctggctctgagcagctggaaactcacccacaatccccaccacgatgtaacctagaatgaagagcaggaagaggacgcagcagatgacatctgtgcagcttctgagagagaaacgaaatgggaggctgagctaaggagacttggggaggtagggcttatggtctggaggggttaagggttagagagttgggtgatgctgcagcatgggcatcagtaggctttatttttatttttttattgcttttacttttttattttgagacagggtctcactctgtcacacagactggagtgcagtggtgcaatcttggctcactgcagcctctgcctcctgggttcaagcaattctcctgccttagcctcccgagtagctgggattacaggcgcgtgccactact

SEQ ID NO: 6052 - DNA, 599 bp, Homo sapiens
tgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgctggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctgggtgcctgcagcggcctcacagtcatggatctggaagctg

SEQ ID NO: 6053 - DNA, 513 bp, Homo sapiens; identical to SEQ ID NO: 1563

SEQ ID NO: 6054 - DNA, 542 bp, Homo sapiens
aagaaaatgagatttgagagtagtatgtagcttagactctaaaataatatctgggagaagtttgaaagttaagcaagtgatgaattaataggattggtcggcagttcggagggcccatccgaaagtggaccgaaatggataggatagatgagttctccttggctgtcatagttcagtgtagagatgctcagagactaggagtcagagcacagtggacccagagggtttgacttggcagtatgatgaaaaattgtagtctgatgtgaatggtcagaagagagagagatggaatatttgaagattgtgagcaggaagtacatgctttttctcaagaaagatgatgacataggttgactgtgagggaatgtatagagatgtcatgacttaactagtgatttgagctccagaatgttaaatgtgcaagagacgtgtcatggagccccttctagtggcaatagttacagtaaagtaggggagacatgaaccaattaaacacacaaataattgaaagtcttaattgtttcactccatatgttattttt

SEQ ID NO: 6055 - DNA, 305 bp, Homo sapiens
cagtggcacaatctcaactcactgcaacctgccgtctcctgagtttcaagtgattctgctgcctcagccttccatgtttctgggactacagacatgcaccaccacacctggctaatgtttgtgtttttagtagaggtggggtttcgccatgttggccaggctgggctcgaactcctgacctcatgtgatccacctgccttggccttccaaagttctgggatttcaagcatgagccactgtgcccggccctgctgggattactttggtctgaaacccactggggaggaaggacaggcctcggaaat

SEQ ID NO: 6056 - DNA, 519 bp, Homo sapiens
ccgcgcctgcaccggcgacatcgcgtctataagctggtggaggacacgaagcatcggcccaaagaaaacctgaagctcatcctgacgcagtcggtggagaatgttggagtccggggtgacctggtctcagtgaagaaatctttaggccggaatcgactccttcctcagggactggctgtatatgcatcccctgaaaacaagaagctgtttggagaggagaaattgctgagacaagaaggaaaattagagaagatccagaccaaggcaggtgaggcgacagtgaaatttctaaaagctgtcgcctggaggtagggatgaagaacaatgtcaaatgggagctgaaccctgaaatagttgcccgccacttctttaagaatcttggtgttgtggtcgccccacatacattaaagttaccagcagagcctatcacacggtggggcgagtattggtgtgaggtgacggtaaatgggcttgatactgtgagagtgcctatgtctgtcgtgaactttgagaagccca

SEQ ID NO: 6057 - DNA, 577 bp, Homo sapiens
  misc_feature 517: n = A,T,C or G
tactcgacaccttgcgatccaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgngttattgaaaggactagccacatactagcatcttagtgcctttatctgtctttatgtctt

SEQ ID NO: 6058 - DNA, 571 bp, Homo sapiens
cagcaaggccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgc

SEQ ID NO: 6059 - DNA, 534 bp, Homo sapiens
agatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctcctatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttg

SEQ ID NO: 6060 - DNA, 482 bp, Homo sapiens
tttattggccacatgattaacttccttctccagctcctctttaatctctgaacatctgggggtgtggctaaaagttccaaccctctaaccatatgcttggtctgtctggcatggccagctcgtcctttcaaactatgtgagggcctaccttgagtcacccccaagtataaactcagatatagtccaaaggggcttcttatgaataacaaagacacttccattaatcaggaaattccaagcctctctaagctctgtaccaggaacaggagacaaagactagatttattcttcattatatgacagatacatttttatattttgcctctggttttagtaaagtttttgttgtgaagaacacaaatgccagatcaaatgagggggctgtaattagcaaggctgcaagggattgtgagcagtaagggagatagggattttactggaaatccgccaaaggaactggtatgtagctatgcctctcagta

SEQ ID NO: 6061 - DNA, 73 bp, Homo sapiens
gagattatagaaattgcactttattggatgcctgaccatattgctagtgtcaccataatctctcccccgtcca

SEQ ID NO: 6062 - DNA, 426 bp, Homo sapiens
tgaacagaaaaaataacagtgctgagagaaagctgttccttctacaaaaactgaaggatgctggcttggtttctgtcgccacagaacaagttaccaaacacaaatttggcagcttgtaacaacaagcatttacactctcacagtttctgtgggtcaggagtctggccatagcttagttctatcctctacttcaggtgtcacaggctgtagtcaaggtgttggctagggcacgctgtcatctggagctcaggtcctcattggtagaattgaatccattgtggttgtgggactgaaaccctgggctcttggaggctgcccctccccacgggcagttcattggctgcttgcttcttcagattggagaccatctcttcaggacggtgcggagggatggaaaaagggagaggcaaatggaaatcacaaaag

SEQ ID NO: 6063 - DNA, 620 bp, Homo sapiens; identical to SEQ ID NO: 1568

SEQ ID NO: 6064 - DNA, 489 bp, Homo sapiens
tcaggggttcaagaccagcctgatcagcatgctgaaaccccgtctctactaaaaatacaaaaagtagccgggtatggtggcgcgtacctgtaatcccagttacttgggaggctgaggcaagcgatcacttgaaccctggaggcagagtttgcagtgagccaagatcacaccactgcactccagcctgggcgacagagcaagactcccatctcaaaacacaaaaacaaacaaaaagaaccatgttactaaatagcctgggcctttcttattaagactagtaactcttttaaagactgttgatcaaaaaatttaagttcttaatgaaaatagaagaaactttaaggttatgtttctgctacttgggttcgataatagtggttctaaaattaggatattgtatttaagcatttgtagtgagctttgggaaattctgttctctaagaaaactttatgagctttaaagttatgtgggacattttgtctttcttt

SEQ ID NO: 6065 - DNA, 440 bp, Homo sapiens; identical to SEQ ID NO: 1569

SEQ ID NO: 6066 - DNA, 608 bp, Homo sapiens
ctaacttttgtatttttttgtagagatggggtttcaccatgttggcccaggttggcctctaacttctggcctcaggtgatccgcccgcctctgcctcccagggtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaagctctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatggga

SEQ ID NO: 6067 - DNA, 589 bp, Homo sapiens; identical to SEQ ID NO: 1570

SEQ ID NO: 6068 - DNA, 650 bp, Homo sapiens
tacggccgggatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcggaaaaaaaaaaaaaaaaaaaaaaa

SEQ ID NO: 6069 - DNA, 216 bp, Homo sapiens
agtgacaggagtggaagcagctcccctgactctgaaatcaccgaactgaagtttccatcaataaatcatgactgatcttgtagcggatgattcttcaagagacccttcaagcttgggtagagtttacagctctgactttacactcggctttggagactttctttaaattatgtttttattaagattattttattatgcggaaaggtatttgggaaa

SEQ ID NO: 6070 - DNA, 428 bp, Homo sapiens
cttaaatgggggacagatgaagaaaagtttatcaccatctttggaacaccaagtgtgtctgatttgagaaaggtgtttgacaagtacctgactatatcaggatttcaaattgaggaaaccattgaccgcgaggcttctggcaatttagagcaactactccttgctgttgtgaaatctattcgaagtatacctgcctaccttgcagagaccctctgtgatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagag

SEQ ID NO: 6071 - DNA, 341 bp, Homo sapiens; identical to SEQ ID NO: 1571

SEQ ID NO: 6072 - DNA, 141 bp, Homo sapiens
taaatgaattgtaggtttttggcttgagccactgggaagatgaacctctgctgagatggagaagcctcaaaaatgaagataactaacctataaaaatttctgatatgccgtatatattgccagggtataatgattatatgg

SEQ ID NO: 6073 - DNA, 744 bp, Homo sapiens
  misc_feature 9, 609: n = A,T,C or G
agacagagnctagctctgtcatcctggcaggactgctgtggtgcaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattctttgtctttatatagctgtttcgcacaagctangatggtagatgtcttgcctgttcctggggggaccgtagagaagcaagtgtggcagtcgggtcttcattgataaacttcctgaatggtcctcagaatgttctggagagaaaatgaatcattcaggtttttgcctcg

SEQ ID NO: 6074 - DNA, 535 bp, Homo sapiens
ctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagatggggtttcatcatgttggccaggctggtctcgaactcctgacctcaagtgatccacccaccttggcctcccaaagtgctgggattacaggcgtgagccaccacgtccagcctggggaaggtttttgtaactgctgctgtgtggtagaatctgggcccttcaaggagcgggtggggtaggatagtgaggggaagcctcccaagctaggacaagagcaagcagaaacaggcaaatttgtgtaagttcaggttcaaggactctccatcctagctcatctccaaagagttgatgtactcccgaacccatttcttctctgggttgcacacacttagcgggtcttttcggtgacaaagacgactgctggggtggagcacttgcca

SEQ ID NO: 6075 - DNA, 509 bp, Homo sapiens
ttttttttttttttttttgctttcctaaactttattaaagaaaaaagcaataagcaatggtggtaaatctctagaacatacccaattttctgggcttcctcccccgagaatgtgacattttgatttccaaacatgccagaagtgtatggttcccaactgtactaagtaggtgagaagctgaagtcctcaagtgttcatcttccaacttttcccagtctgtggtctgtctttggatcagcaataattgcctgaacagctactatggcttcgttgatttttgtctgtagctctctgagctcctctatgtgcagcaatcgcagaatttgagcagcttcattaagaactgcatctcctgtgtcaaaaccaagaatatgtttgtctaaagcaacaggtaagccctcttttgtttgatttgccttagcaactgcatcctgtgtcaggcgctcctgaaccaaaatccgaattgccttaagcattaccaggtaatcatcatgacgctgaatctgaag

SEQ ID NO: 6076 - DNA, 560 bp, Homo sapiens
tttttttttttttttttttttgaggaacaattcttttattgtacattggagaaatagccctgtgtgctggttcaaggtgcaacatacagaatattgaattaagaaaagagggaacggggaagggaagggaaacctcttgaggtccaaagctgcaaacaaaaaatggtaaaagatttcctcacgcaagaggcatttttgcaaataccatgcaaaacaggcagctggtgtgccttaagagaatccctataaataacagaaaagacactccaagcattcctgtacgtggactcagagcacagagaaaagaaactaaaatgccttttggcatttcaagatatttggcactcttgtgattacatttttttacagtccattaaagagagtaaactgacataatattagagaaataaacaggctgctcacacaacagactgcaaggggaagttagaaaaagctcaagcatttttttctttgtttttcgtgtgtgtgtgtgtgtgtgtgtgtgtgtgtgtgtgtgtttttctggcataaaaaatgtgtccatttgcattaacttgggc

SEQ ID NO: 6077 - DNA, 240 bp, Homo sapiens
tttttttttttttttttttttttgggatcacaggctttattcctacaaccacagggcttgagcctgactggggcaagaaaacagagtttcatctgagaatgtctcttatgggctgggttctgttcaggggagggtgggaacagaggacaaggaagacaagctcctctggccctaggaacaaaacacatttactccttcaaagaagcagatgatctgaataccctctggagactgaatctg

SEQ ID NO: 6078 - DNA, 424 bp, Homo sapiens
ttttttttttttttttttttttgagatggagttttgctcttgttgcccaggctagagagcaacggtgcaatctcggctgactgcaacctccgtctccggggttcaagcaattcttctgcttcagcctcctgaacagctgggattacaggcgtgcgccatcatgcccagctaattttgtatttttagtagagatgggtttatacatttttaaagaatggacaatgatgcagatgatttgtgagcattttgatgagaaagtggtgattagaaggatacagcataaatttaattgtaaacatgcttatctagctaacctaatctgtttctgtagaattactggcatgggagattggatagatgcctaacctatctcaattttaagtaatgtgagcaagactttaaggtatacataatgataaaatgg

SEQ ID NO: 6079 - DNA, 360 bp, Homo sapiens
ttttttttttttttttttttttttgggggagggaagggacatagtttccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatga

SEQ ID NO: 6080 - DNA, 561 bp, Homo sapiens
tttttttttttttttttttttttagcgaacccacagttcagttttattcagagcaaagaaaaaagaaactttccatcatactagaagaaacttggccgtaaggtttgggatctgtgctcaaactacacatgcaatgaggacaatattctgctaatacaattgacttgctgctgcatttgtctactgtttgtctaatattaacaattataaacagagcagtgcaactagtatttggaacaatccctacagtgttacagtgtcaggcacaacatttcacttctcttcacaccactggttctctttgcgtacctgggcttcctcctcttcagtaaagtcatttttgatattgaaggtcttgcgaatctcctcaggagttttccccttgatcatattggcaacagtcttgcatgtaacatcaagcaaacctttgatgtctaagtagtttgcagccagaatgagttcaaaaagtgttccttggtcaactttcaggaattcttggtcccaaacagggataacatctgttcgcttttctttgttctcatcatcttcaggaggaggagg

SEQ ID NO: 6081 - DNA, 591 bp, Homo sapiens; identical to SEQ ID NO: 1579

SEQ ID NO: 6082 - DNA, 444 bp, Homo sapiens
ttttttttttttttttttttttttttatagagagggggtttcaccatgttggccaggctagtctcagactcctcctgacctcaagtgatccacccgccttggcctcccaaagtgctgggattacaggtgtgcaccactgcgcctagacaaaagccagacttttgtggtcctacaattgcaggtggattttgataaccatcttgaaagttactacaatgtacaggcttcctaggtatctctgtctcaatctagaagtgaacctattatcatttaaagacaccaaggttgtagggcttttacagcatgatccatgtctgaaatgacacatgttatttaagaacagaggtgctgtcagtggtaaaatatgacatgccaggaaaaacattcttgatggcttttatattgctgattaatgaagccaaggaactaggttcaaattatgtt

SEQ ID NO: 6083 - DNA, 314 bp, Homo sapiens
ccactccttgaaccagaacctcttttactttcttatgtagttcttctcttcctgtttttatatcctaaaactagtccagcgaccagcccatcgtagtagaagcgttggtgttcttcctaaaaggaattgtaaacatctcttggagagtgggttagccaccataaattgttttgggacttcggatacccccttccgcaaatgctatctagagatgctttaatttcatttcaattggttattgcatccctgatattttgaaactgttatgagtagaaaacattctggtttatgaacaatctgtttttcactatgaa

SEQ ID NO: 6084 - DNA, 538 bp, Homo sapiens; identical to SEQ ID NO: 1581

SEQ ID NO: 6085 - DNA, 376 bp, Homo sapiens; identical to SEQ ID NO: 1582

SEQ ID NO: 6086 - DNA, 478 bp, Homo sapiens
ttttttttttttttttttttttttacggggagacaagtttattgaggagcttgacacccctcttctgccctagcttgagagaacaactgcagcatttttttctttttctcttcccgatgaccatcttttgggctggcgggccaggcccctgggtgtctcccatatcgctgtctttagtgagactgaggatctggtataaggaaacagatcagctgcagccagtgggggcccctgcgttgggcctgggagagagaaggtcctgttcctgcctttcctgtggccccaggcactctcagctctgaagccaggctattgctcgacaccgcaggatgcccaggactccctggaaccaggagcaaatgggcgcagtcctttccccgtcagagccacccaccagcttccaggcttcctgcatcttccaggggtccagcctgtgggacgtcagcaggaatttcccatagcagcaccggtctagcgg

SEQ ID NO: 6087 - DNA, 562 bp, Homo sapiens
aaaaatgagaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagc

SEQ ID NO: 6088 - DNA, 419 bp, Homo sapiens
taaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaatt

SEQ ID NO: 6089 - DNA, 437 bp, Homo sapiens; identical to SEQ ID NO: 1585

SEQ ID NO: 6090 - DNA, 445 bp, Homo sapiens; identical to SEQ ID NO: 1586

SEQ ID NO: 6091 - DNA, 596 bp, Homo sapiens
tacggccgggattactgtgtgacatattattattttgatgtactacatattattgatccaggtcccccagtgtttcttgctttggttatttacttttttaaaaaataagatacattaaacacttatgcagtcattctaggaaatacatttgtcttaaccccagccaacactgggttgttattattgttttaatctgtaccaatttgatagacaaatagtgatatattgttttcattttatttctttgattacaatggaaagataagatgcatttaataactgttagactaattattagaagatggaaacctattctgtgtctccactgggaacaaaatttaaaatggacttaagtcaattacatagcatttgatttctcatttatgattattattttgatactaagagcagaaatcttaaagtatgagaaaccactcaagaatatttattatatgtcattaataaaattattttggcaatttattttcaagtgaattaatttatgtgtaaacagtaggtaaacataaaggcaatgtgtctggatgatggaaagaactttgcaatggggatagtagcaaaggaataaatgtttcatc

SEQ ID NO: 6092 - DNA, 637 bp, Homo sapiens; identical to SEQ ID NO: 1588

SEQ ID NO: 6093 - DNA, 463 bp, Homo sapiens; identical to SEQ ID NO: 1589

SEQ ID NO: 6094 - DNA, 535 bp, Homo sapiens
atttcttcagactaacatcttaaaacactgacctctatgaggtatttactgtgcaataactgattcatttttttcagagcttgaagcatccaatgatttttccctccactgctgttaattaatgtcacttccaatatataaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatga

SEQ ID NO: 6095 - DNA, 121 bp, Homo sapiens
gattatggggtcttaaaggctgatgaaggcatctcgttcaggggcctttttatcattgatgataagggtattcttcggcagatcactgtaaatgacctccctgttggccgctctgtggatg

SEQ ID NO: 6096 - DNA, 349 bp, Homo sapiens
cctatagtcccagctactcgagaggctgaggctggagaatggcgtgaatgcgggaggcggagcttgcagtgagctgagattgtgccactgcactcagcctgggcgacagagcaagacccgtctaaaaaaaaaaaaaaaaagggaaaattttccttgcaaaaaaaaaaggtttaaggaaattttcaaattggggtaaacccagtggcccccccagggggcctttgtaaaaattcggaaataaattttggctcccaaattctttaaccctttttttgattaagggatgggattctttccttttaatccccaaaattttagggccccggccccttaaaatggccaaaaaaaa

SEQ ID NO: 6097 - DNA, 107 bp, Homo sapiens
gccagtgaagggagcatacagagagcacccatatggacgttattaaaaacaaacatgaggggaaaatatcagttatgagcaaagttgttactgatttcttgtatctc

SEQ ID NO: 6098 - DNA, 527 bp, Homo sapiens; identical to SEQ ID NO: 1591

SEQ ID NO: 6099 - DNA, 444 bp, Homo sapiens
gggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccc

SEQ ID NO: 6100 - DNA, 491 bp, Homo sapiens
actgtgcagtgtttcatatgcatatttcacagtaaccttcagcaaaataccatcttttacctttaaaaaattttttagcacaagatggtgaccttagctcaactacagtggcttgactttggaatctttgaggaattaatgcgcaagaatttaaaataatcaggggaggacaaaatttgtgattcacacacatgaaagaacagactgtccaggcaacaagggatgcaaggcaaaggcaagtctaggtcctcagactttggagcacctgcgagaagattatactagggatgccacatagagcaaggatcctgtcatggcccacatggaacttcaatcaatatttcttgatgtgtccagtttttctagttgtccttagtgggggagttgatctgagtttctcagttagccattcctagaagtcccctgctccttccaaatcctagaattcgtgaattacaacctagggggacagattcttctttccatgctac

SEQ ID NO: 6101 - DNA, 472 bp, Homo sapiens
gcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaag

SEQ ID NO: 6102 - DNA, 75 bp, Homo sapiens
ccccagttaccagagactcgaacttccagacagagacccagggacaccccgaagcccacctgcaatctcccacct

SEQ ID NO: 6103 - DNA, 442 bp, Homo sapiens
aggttgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttc

SEQ ID NO: 6104 - DNA, 562 bp, Homo sapiens
atctgctctttaaaactaaggttgtatactttcattacagtaatacacgtcattcattaaattatcttgtggcttagctttacaaattcttaccgttacatgactttgggtgaatgacctcaccggtgtctatatcactcatgtgtaacatgagaggagtagattaaataaacgaaaggatttctttcaactccaaagctatgacaatgtattttcaagattgtgtacttcttagaacaggctcaataataatttttcacattatgaactttgcagtcaaagaataggttcttcttaacctaacaaatgactatcctttccacccaaagtataaacaggatcctgattaataaattgagttcaaagaatctctgccaagtgtgcaaaatcactgcctctgtttgtcggacattcattgcctctaagaattgatggaattgaaaataacctcattttactgggacctcagagaattaattatttaaattttttgctgctttaaacattaattttcttaatttacccatatatgttgctgataagagctgtaatattttgaatg

SEQ ID NO: 6105 - DNA, 504 bp, Homo sapiens
agttcgaatcgcggtgcgacgaaggagtaggtggtgggatctcaccgtgggtcccattagccttttctctgccttgcttgcttgagcttcagcggaattcgaaatggctggcggtaaggctggaaaggactcccgaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggatt

SEQ ID NO: 6106 - DNA, 523 bp, Homo sapiens
tacggccgggttccttttactttttttaaccttcccctaagcagcctgagggttgactggattggtgaggcccgtgtggctacttctgcggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtg

SEQ ID NO: 6107 - DNA, 107 bp, Homo sapiens
ggaccctgtggcgcgctactttgggataaagcgtgggcaggtggtgaagatcatccggcccagtgagacggctggcaggtacatcacctaccggctggtgcagtagc

SEQ ID NO: 6108 - DNA, 270 bp, Homo sapiens
cacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggtgagtaataacctgtagcagtttggttgctggttaattctggattgtgaatctccatgtatctttgggacctgtcagccgtggcagtc

SEQ ID NO: 6109 - DNA, 428 bp, Homo sapiens; identical to SEQ ID NO: 2812

SEQ ID NO: 6110 - DNA, 452 bp, Homo sapiens; identical to SEQ ID NO: 1599

SEQ ID NO: 6111 - DNA, 363 bp, Homo sapiens
tatgatgggataggttgagggggctgggttcctccttcctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctg

SEQ ID NO: 6112 - DNA, 637 bp, Homo sapiens
gcggcaacacatggtgcacgtgtgctggcgccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagccacaaagagtctcttgtgtattgatggccggacacactcgtttccgcagtggctgctttcctggaagacgtttcctttcttctgtattaatgaggcctggtaaaattaacacctgtctgaaaatcaaaaacatggcttcccagcagctctcctgtctccacagccgcgttttttaaccccgacctctcagcgtctgaatgagcagcgctcccacctccagtcctggcatccgctgggggcgct

SEQ ID NO: 6113 - DNA, 444 bp, Homo sapiens; identical to SEQ ID NO: 1601

SEQ ID NO: 6114 - DNA, 550 bp, Homo sapiens
attaaatctgctcacaaaaagaagattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattataaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgaccccttctatttcccacactatgaggttcccctggctgcagttttggaggcttatgtagaagacccggaggatctaaaaaatgaggaaatggatctcgaagagccagagggctatatgccagacctggactccagggaggaggaggccgatggctctcagagcagctccagttcctcggtgccaggagagagcctccccagtgc

SEQ ID NO: 6115 - DNA, 557 bp, Homo sapiens
gtgctgcagaaaacaggtggactgtttggattagcagtaggtctcatgcagttgttctctgattacaaagaagatttaaaaccgctacttaatacacttgggctctttttccgaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttggttggacctcatagcttattttagttaatcttttttttgtcttttagccttaccaccttttaaaaaatttgttattctc

SEQ ID NO: 6116 - DNA, 567 bp, Homo sapiens; identical to SEQ ID NO: 1604
  misc_feature 519: n = A,T,C or G

SEQ ID NO: 6117 - DNA, 52 bp, Homo sapiens
ggagtgggggacggcgcagcatcaagacttgcactgaaaatttctgctttga

SEQ ID NO: 6118 - DNA, 556 bp, Homo sapiens; identical to SEQ ID NO: 1605

SEQ ID NO: 6119 - DNA, 260 bp, Homo sapiens
gactgctgtaagacgagtgaacctggggccacttctgaaaacacagattgactgtagaggggacagtgcccgaagtgtgatcacaggtttcagaaagactggggcgcacagcttctacccagttatccactgaaaatccggtaaagccattcctaactatgccattcagttcaacaaataacgactgaatgtattcttgagttctggcgccgcgttacgtgctctggagtggcggaataaagccggcctcttaacttccg

SEQ ID NO: 6120 - DNA, 552 bp, Homo sapiens
atgaaggatcttattgggagggataaaatgttctaaaactgagtaatagttacagctacaccactgagggaagttactaaaatcactgaaatgtacacttgaaatgggtgttttatgatatgtaacatatgcctcattaaagttgttttaagaaaaggattccctgcctcccaaaccatcctttaagcattaaacatttttggaggctcataatcaacaggacagaataactacttagtgatgatttacagagtgaaatattttactgttttgtagtaagcacattttagtaactgtacactagtacaatgtttttaagattttatctcatttttgtcatattagcctaaaatgtttatttttatttaaaaagtagccaataggaaggtaagattggggagaaagctcagtaaatgtcacaaaagaggctcctagtaacacaatctgagggagctttttcttttgaaataaagatggtgcatctgcccctttacagatttctctcctgtcccctgggactggggaaggtgaatcccctgcctgacaccttgt

SEQ ID NO: 6121 - DNA, 589 bp, Homo sapiens; identical to SEQ ID NO: 1609
  misc_feature 509: n = A,T,C or G

SEQ ID NO: 6122 - DNA, 618 bp, Homo sapiens
tagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgta

SEQ ID NO: 6123 - DNA, 634 bp, Homo sapiens
tacggccgggtgtagtggctcatatctgtaatctcagtactttgggagatgaaggtgagaggactgcctgaggccaggagttcaggaccaacatgggcaacaccacaagaccccatctctacaaaaaaccttaaaaattagcttggcgtggtgtgcacctgtactatctactcaagaggctgtggagacagcatcacttgagtccgggagtttgaggctgcagtgggctatgaccatatcactatattccagtccaggtaacagtgacaatccgtctcttaaaaaataaaataaattgaaaaagaaaagggacattaagaagagcaggaggtgaaatagagggagagagagggccaggagagggaggaagaggaggaagaagaggagaaagaggagaagaaagaaaacctaaattcgaggaaactccagaattacctaaaactgaataatgtgctaagctatcacagaaactattttggcataattctgaatgaacctacataaggaataaagaaattgcaaaacaaattctcaatgcattaaataaattagctggtctaaacagaaacagatgtgaaacctggaaactactattaaaaataaaagaatgcagtagtctcgatgctgctcaccc

SEQ ID NO: 6124 - DNA, 597 bp, Homo sapiens
gagggcacccattctgaagaggaaggctttgccatggatgaggaggactctgatggagaactgatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaataggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaa

SEQ ID NO: 6125 - DNA, 591 bp, Homo sapiens
tgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaat

SEQ ID NO: 6126 - DNA, 415 bp, Homo sapiens; identical to SEQ ID NO: 1612

SEQ ID NO: 6127 - DNA, 613 bp, Homo sapiens
agagccaggcgtccctctgcctgcccactcagtggcaacacccgggagctgttttgtcctttgtggagcctcagcagttccctctttcagaactcactgccaagagccctgaacaggagccaccatgcagtgtttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgccaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctac

SEQ ID NO: 6128 - DNA, 451 bp, Homo sapiens
cggccgggcacaatggcttatgcctgtaatcccagcactttgggaggcaggaggattgcttgagcccaggagttcaagagcagcctgggcaacatgacaagaccccatctcaattaaaaaaaaaaaaaaggggaaaaagaaaaaaggccgaaaagtaaaagtaaaaaataacctttttgtaaacccccccccgccaaaaaaaaaaaaaacctttatgatcttttttcatttttaaaaaaaaaaccttgtttttttcctaccccccaagggggacaaaggcttttttttcaagtttagctttaaacggggggaattttttttaataaagggtcttaaatcttttgcaaacattggtttttggatgtccaaaggggacctttttcccccaaaaaaaaaccccttcaagtgggctgcttttttttttaaaaaataattctttcttgaaaaaaat

SEQ ID NO: 6129 - DNA, 388 bp, Homo sapiens; identical to SEQ ID NO: 145

SEQ ID NO: 6130 - DNA, 296 bp, Homo sapiens; identical to SEQ ID NO: 1614
  misc_feature 64, 187, 195: n = A,T,C or G

SEQ ID NO: 6131 - DNA, 51 bp, Homo sapiens
cgataccatgcccacagatctgatgctcttgagctgggcctggggaaacat

SEQ ID NO: 6132 - DNA, 80 bp, Homo sapiens
gcaaagacaccaacggctcccagttcttcatcacgacagtcaagacagcctggctagatggcaagcatgtggtgtttggc

SEQ ID NO: 6133 - DNA, 108 bp, Homo sapiens
gtgccatcatcatgattctgggcttcctggcatgctgcggtgctataaaagaaagtcgctgcatgcttctgttgtttttcataggcttgcttctgatcctgctcctgc

SEQ ID NO: 6134 - DNA, 118 bp, Homo sapiens
caaccgcggccgggccaccgacaggtcctcgggcaggtctgaagacgtttaccagctgctatgaatatgtgctgggggagggcgctcatgcctgattgcacacctgcatcaacctgat

SEQ ID NO: 6135 - DNA, 542 bp, Homo sapiens
gaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagc

SEQ ID NO: 6136 - DNA, 545 bp, Homo sapiens
aaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggtggcactcagaactgaggccgacaccttctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatgga

SEQ ID NO: 6137 - DNA, 574 bp, Homo sapiens; identical to SEQ ID NO: 1619
  misc_feature 58, 278: n = A,T,C or G

SEQ ID NO: 6138 - DNA, 588 bp, Homo sapiens
  misc_feature 363: n = A,T,C or G
gttttacaatactgaagttataggaaacaagcacaaaaggccattgggtggggctggatggagcatgatctggtcctttaaagtatgcagatcgcctgggaggcccagcctatggagattgggaggagagggagatgctggtgactggagatggtgagagcctgggctggggtagtttttagtcatgggcttatggaccctcccctcttctccagctagctcaggcctttaagaggcaggcccaagaagggaaccccaggaagccctagaagctccccagcgcctccatcccatggacccggatcccctgcaggaggggaagttgagcagtggcccaaagacacagtcgtcctcctggcttgnggcttgggttaccagggtccccaaggggctggcctggaaccagaggttctcataggacttggggcttggggtgaggcccgccaagaggggctgagtggagtcacagcggagatagtgccctggccctgggcttgtggggctgcccagcagctgcccataaaggacctgatcgcttgtgccagactgggattggggctgggtggaaactgctcttggtccccctcg

SEQ ID NO: 6139 - DNA, 631 bp, Homo sapiens
  misc_feature 624: n = A,T,C or G
catgcttccacacctttcttgctgaaggacaaagtacataaaatgccggtgtttggcttccagatctgaaggaagctgtttagtactctggcaggatcacatcttgctgtggaacttcaaaacccacagcagagcttccttgcccttctctgggagctgctacctcctccacagtcttcagcttctcctctgctaggccctcctctagttccaggtcagccacctttatcccatcctccactgccttgggcaccattttgggggcctcttcagcatttatatctgcacctttaactttctctaaggcttgcaccttcatcagctcagcctgtgcccccttaactgcggcttgggccccatcgccttgaattttctctccttctggaatagctttcatgtcctcgttgccatcttggattggagaagggtctcggctagccttgtggctctcctggatgctgccatggctgctgctggcacttcccaggcgggaagaggccaccacagccttcaccgctgccttaagcttacgccgggcattgaattcttggagcttcttttgagcggtattcatgtgtaccaaattggctgctttacctgtgacccacggatgctggagagctngaaatga

SEQ ID NO: 6140 - DNA, 208 bp, Homo sapiens
ttgaccacttcctgcacacccagctctgtgctgagtgctgatcttgtaaaataaaatgcatgtcacctgcgaaaaaaaaaaaaaaaaaaaaaaaaaaaaaaaaaaaaaaaaaaaaaaaaaaatattttggggggggaaattttttttttttttggggggggtttttttttttgggggggggggggtttttaaaaaagggggggggggg

SEQ ID NO: 6141 - DNA, 747 bp, Homo sapiens
  misc_feature 599, 621, 632, 658, 697, 726: n = A,T,C or G
tggtggttgctttgaactttatttgagaaaaacagaagataaatgtatcaaaagaacacacaggtggcgggggaggcacagccagtggcggcagcaggggtgggcatccgggctaaggctttacttggcggcagtctcatcggattttgcagcttctgggcccccaagctgggcccgcgactcgaaggtgactgggatggtgatctcgttggactgcgtggctagcttgggcatgggggcctccacggtcagtgtgccctcaggggacagggaggaggaaacttgggtggggtccacaccggggggcagcgtgtatttccgcgtgaagcaccgggagatgtagccatgctcgtcctgccgctcctcgtgcttgccggtgatctccaccacgccatccttggtcttgaccgtcagctcgtccggggcgaagtggttgacatccagggacacgcgccagcggtccgcagtgtgccggatctccgagaccccgctgctgagttgccggctgagcgcgcggctgtaggcgggcgccgccactgcggggctctcgatggcggcggggggcagggggcgcacgtagcctggccagctgctgccgnctaaccactgcgaccactcctncggcagccggngcagcccgaagcctggtcgaagagcngctatgcgggtaccagtcgcgggaggggtcccagctggnggcccgcaagagcgagaaagggacgcggngcttcgtcatgctggctgact

SEQ ID NO: 6142 - DNA, 554 bp, Homo sapiens; identical to SEQ ID NO: 1624

SEQ ID NO: 6143 - DNA, 527 bp, Homo sapiens
ggagtggtcaacacccagaacagatctctttaatcagaagagactggcagggggagaaacaagattgctttctggccatagtgagtccgaggaccgcgtttgcagctcccattcttcttgaggccaacaaaccaattcttctctgcatgcttcttggatatataggtgttgtaatggttctcctccagcctttccaggaacaaacattcctcatttggtgtctgtgagccgtataaaagcccgtcggtgtccatggccaagtactggccagtctcggtactctttatatacacctcccccacgctttccgcactgagctgcagctgaatgtgctggtcgctcctgtcccttgtcccatccactgtgccatccggaaggatcctcaggaagtggcccccgttgctacagtagaggagtttgggcttcttgtaattccctggaggcagattaaacttctcggtcagggctgtgaaggtggtgatttccccttcagccatggctcagcagctgctgcttgtggcgctttc

SEQ ID NO: 6144 - DNA, 355 bp, Homo sapiens
ggtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccac

SEQ ID NO: 6145 - DNA, 607 bp, Homo sapiens
tcggcacgagcgacagatcctactggctggccagcgctgcgcccctccccatgatgccactctctgaagaggcgatccgcccctatgtcagccgctgtgcggtatgcgaggccccggcccaggcggtggcggtgcacagccaggaccagtccatccccccatgtccgcagacctggaggagcctctggatcgggtattcattcctgatggtgagtcccgtgcccttgaaaaccctggctcattcaccatttcctaacaccttctcccgccatttctctctggattggacagtaattctgagcactctgcgcttaggacataaggtcacggggactgttgcaaaccatagcctgttgggatgcagggccattatcttttaaaaacacttgtgattgattttgatcacattggtagaatttaaaagatgagtttgcttcagccatcggtgaaactggagccaatttgtgtgcatacttaccatgctgagtacgactccttttcagcgcttgtattttgttctttatggaataatctaaggaaaaatgttaagatcagacccaaacctgggtgtgtccctgattgggtctggggttgtctgtgtgtgtct

SEQ ID NO: 6146 - DNA, 304 bp, Homo sapiens
ccatcactgccatctgggaaacccggctaaaggcccaaccctggctcttcgacgcccccaagttccgactgcactcagacaccctggcgcatattggctctcgggggccacaactgctcctgcgcctgggccttacttgctaccgaaacttcctgggcaccaactggaccatctcagctgcctggctgcgacagcaaggtgccaccgactggggtgacacgcatgcctataaggcggacccactgaaggtgggcactacactaaccacagccgatgacttccttgacttcctgcgccgctcccg

SEQ ID NO: 6147 - DNA, 557 bp, Homo sapiens
ttcggcacgagggatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatccc

SEQ ID NO: 6148 - DNA, 490 bp, Homo sapiens
  misc_feature 30, 381, 386, 415, 462: n = A,T,C or G
gggagcttcctgagcccctgctcacctttnacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggcttctggaacctgggcccctgccccaccagcccnttctntggtaagcccgggtttggactcttcctcngggcatcaggggccatgaagcccctgggagagagatgttggagccanccttaggcatgctttgccccactttgtt

SEQ ID NO: 6149 - DNA, 623 bp, Homo sapiens
ttcggcacgaggccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttg

SEQ ID NO: 6150 - DNA, 625 bp, Homo sapiens
ttcggcacgagggttcacctgccgcgtggatacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctga

SEQ ID NO: 6151 - DNA, 561 bp, Homo sapiens
tcggcacgagggcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattag

SEQ ID NO: 6152 - DNA, 602 bp, Homo sapiens
aatttggccctcgaggccaataattcggcacgaggatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagccgcagcagcagcagcagcagcagcaacagcagccgcagcagcagccgccgcaaccacagacgcagcaacaacagcagccggcccttgttaactaca

SEQ ID NO: 6153 - DNA, 502 bp, Homo sapiens
  misc_feature 2, 43, 82, 267, 372, 435: n = A,T,C or G
gngaccgctgccaatcactcccattgggtcgacagcggccatngaggaatggcatcaccagctgccggatgcggactgagantgagccatcttgtggtccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcancgaggggagcttccggagccacgagagccccagcgacacggaagaggacgacaggaagcacagccagaaggagcccaaggattctcttgggggacagcgggtacnattcccaagcacaagaagcgccagaactttccgccaaggccaggaaggtccccagcgacacantggcccctcaaaaagagacgcaccgaaaagccccccgagagcgatgatgaggagatgaaagaagcgg

SEQ ID NO: 6154 - DNA, 634 bp, Homo sapiens
  misc_feature 615, 616: n = A,T,C or G
aaagatagttaatttattataacatggtattacttcagttgttgatgttgcatatctttggaacacatgttggcagagaaaaaagaggccttcccctgatatattctgtcttaatcctgttttttaccctctgatagctgcatgacactcaaatggtatgtcttctattcagatgttcacagatgatgtgcaggaacagcaaacaagatgaaaaaaactaatgaaaactgctcagaaaaaagaaaaggtaaaaaggaccatctcatagagcaacgcattcctgtcactggaagtgttcagacaaagtgtagaaggtgacctgtgaatgctcatgtaccttaagccatgggtgattcagtgcttcataaacagtgatcctttcagctggatccagcatcagcatgcgacgtactaggtctttggcactttcagagatatggctccactgccttggattcatcttatattttcctttaataatgccttcaaacaatctttccttggttccgtaaaaaggcaaacaaccactgagcaggataaaaaggatcacaccgcacccccagacgtctacaggccttccgtaaggctctcttttgaccacttctggtgccatannaatgagtgttccaacacg

SEQ ID NO: 6155 - DNA, 770 bp, Homo sapiens
  misc_feature 289, 562, 667, 668, 684, 685, 707, 760: n = A,T,C or G
ctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactntgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcanatttgaagacaagcttccggaagatatggcgaggttctacattggtgaaatggtgctggccattgactccatccatcagcttcattacgtgcacagagacattannacctgacatgtccttnntgacgtgaatggtcatatccgnctggctgactttggatcatgtttgaagatgaatgatgatggcactgtgcagtnctccgtggcg

SEQ ID NO: 6156 - DNA, 369 bp, Homo sapiens
catacatttttcctggggctcgcacttgacaggcccaaacctttccaaatccgccttttcctaaaactctgtaatgtctaaatgggttctttgttacgggttgcctttccacccttttcctttgtaaaacctgaaaaaaatatgacctttttgggtattcttcaaagggtcccccttttaggaagttatgggcacctccaccctttataccctaagtttctccttttaaaacattcctaaaaggcttttttgaaagggttctcctccttaagtcccaatctacattttgtcacaacatctggaggtttttctggtaaaggggctgccaacttatcattgaaaaatctttttaaaattgacagcccacaa

SEQ ID NO: 6157 - DNA, 479 bp, Homo sapiens
  misc_feature 212: n = A,T,C or G
ccggctgcgccagagtccgcgcgatggagccccggccgcggcggcggcgcaggagtcgccccctggtcgccgccttcctgcgagacccgggctcgggccgcgtgtacaggcgcgggaagctgatcggcaagggcgccttcagccgctgctacaagctgacagacatgtccaccagcgccgtgttcgccctcaaggtggtgccgtgtggcggngctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgc

SEQ ID NO: 6158 - DNA, 560 bp, Homo sapiens
  misc_feature 13, 15, 18, 22, 346, 451, 515, 526: n = A,T,C or G
gagcagcggcgangncgnacgnatgcatcggacgacgaggaggagacgtaccggctctggaaaatccgcaagaccatcatgcagctgtgcacgaccgtgtaatctggtgacccaggtggcctccaccacgttctcccgtcctggggtgaggcttcctgtggcccagccgccccattcacctgtggatttgtgcgagatgcagcctcagaaggaacaaggcccccagaggacggtcacctgggggcagctggtgccgggtcttcacccagaccacgctgggtcccctctgttgggggtttggggtccgggtctcccaccaagccactgcttcctcctgggccctcgntttccacccctcgtcttccctccctcgggggccctgatgcgtggcggcccccgcccgggcctcggctcttttactccattcacagccgtgcacgcgctcaaagcnaacaggggtgcgaaaatgcaagctcttggaattctctcgttgttgtaagaagtttggtgttttnaaatggtaaanatgtttttaagaaataaaatttgcttgatacaga

SEQ ID NO: 6159 - DNA, 574 bp, Homo sapiens
  misc_feature 189: n = A,T,C or G
ttcggcacgaggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcantgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccagggaccctgcccacttcctggacttcgtgccttactgagtctcta

SEQ ID NO: 6160 - DNA, 415 bp, Homo sapiens
  misc_feature 384, 401: n = A,T,C or G
gcactgctaaatatggttgtctttattttctttttccttgcccagccctagttgccacccacatgcctccagcgatcaaggggaccagtctttcaggcaaggcccccatctggcctcctggctcctggagacagggtctgggctctccaggtcctggcctgcctcgtgctctggcagccaaggccccagaggctctcaagccacagaagctccctctcatttggaactccctgtgcttccagcaaatgccaaagcccctcagaacactccatcacaggcaggggtagggggacatgagggccctgcacccacattgcacctgggagagcctagctggtcctcactgaactcttcttgggactgccttgccccggtcaggccggnccagggcagatttgggntggttcagattctt

SEQ ID NO: 6161 - DNA, 501 bp, Homo sapiens
gaacttgcaccgaagctcactcgagaccccaaacctccaggcctgaggcccagccagcgcccaatggatgacaaaaagaagaaacggagtcccaagccctgcctggcccagccagcccaggccccaggcacactacggagggtccctgtgcctaccaaccacaacggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaa

SEQ ID NO: 6162 - DNA, 305 bp, Homo sapiens
cggcacgagttgcctttctaaaagctgtaactgtctttctctgactaaattgtcctacatagatcatttcactttttttttttttttgggcaaatttttaaagggggcggaaaagttaaaaataaggggaacatcttgtcttttatggcccaaacaagaatgtttttcccaaaaaaaggcccccttctcaatacccccctcctaaaaaactaacggtttaatataagaaaagggtcctttaacgggcaaaaatcggttttaactggttccgaagggtaaccccccttttttccccccattttttc

SEQ ID NO: 6163 - DNA, 448 bp, Homo sapiens; identical to SEQ ID NO: 1635
  misc_feature 172: n = A,T,C or G

SEQ ID NO: 6164 - DNA, 561 bp, Homo sapiens
  misc_feature 176, 241, 399: n = A,T,C or G
ctgaggcgggccctgtgctgggggtggtagaaaggatgctgctgaggcagctggaggagtgggagtagctcaaaggggagggctgttggatgtatggggagctggcagagcaggtggcagtcactgggacaaggagggacttgcctctcttctcattattgtgtcctttgctttantgtcagtcctggacttgtgcaggcctgttttgtgtagatctgttttggaagatggcatggtctangtggttgaaggatgtagtagaaggatggatggtggaaggtggggacgttggtggctggctgaggtgcatgggccccacacaggacagctggagaatgggccgtccacttggcctcgttctgcgaggggctcatgggtctgaaagcccccacccactangcttgattgcatccctgttgtgccctttaagaaacatgtttccaccccacccccaaccttgtcccaagtgccctggactaaatttcctgtgccagtgactgcagttggccaagggacaatgtggaaaacccagtgtccatctttccaccctccctgatctcc

SEQ ID NO: 6165 - DNA, 521 bp, Homo sapiens
  misc_feature 188, 343: n = A,T,C or G
ccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcanctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcanggaatacaggggagagggttgtccttccccccagcaaatgcaataatgccctcacccctcctgagaagagccccctccctgtggagcctgttacctccgcatttgacacgattctgctgtgaaccccgcaacctcctccccacctcccatctctccttccaggcccatccctggccca

SEQ ID NO: 6166 - DNA, 542 bp, Homo sapiens
agacaataaggccacagcactttatgtaggacagacacacagtattcccctagtattcatcccccctatcttttcttccccccactccacactatccatgcccacctccttgtaatccttctccagggcagtcatatcctcatgggccttggagaactcaccctcctccatgccctcacccacatatcagtgcccaaacgccctcttggcatacatcaggtcaaacttgtggtccaggcgggcccaggccatagtgatggctgtcatgttgctcagcatgcacatggcacgttgcactttaccaggtcactcccaggcaccacagtgggaggctggtgattgatatcaaccttaaagcctgtggggcaccagtccacaaactgaatgctgcacttggtcttgatggcagcaatggcagcgttgacatccttgggcaccacatctccatggtatagcaggcagcaggacatgtacttgccgtgccggggatcacacttcaccatctggttggcaggctcaaagcaggcattggtaatctctgc

SEQ ID NO: 6167 - DNA, 449 bp, Homo sapiens
ttcggcacgaggggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctacatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaac

SEQ ID NO: 6168 - DNA, 639 bp, Homo sapiens; identical to SEQ ID NO: 1637

SEQ ID NO: 6169 - DNA, 650 bp, Homo sapiens
  misc_feature 407: n = A,T,C or G
ttcggcacgaggtgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcangccctctggaaacagttccagagtttctgctgctctctgtcagagctcttcatgtcctctttccagtcctacggagccccacggggggacaaggaggagctgacaccccaaaagtgctctgaaccccaatcctcaaaatgaagatactgacaccacctttgccctccccgtcaccgcgcacccaccctgacccctccctcagctgtcctgtgccccgccctctcccgcacactcagtccccct

SEQ ID NO: 6170 - DNA, 478 bp, Homo sapiens
agaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgcttataaaatg

SEQ ID NO: 6171 - DNA, 650 bp, Homo sapiens
  misc_feature 82: n = A,T,C or G
tcggcacgaggatcccgtccatcaagtggtgcggagctgagggcgactacaacgtgatggtcatggagctgctggggcctancctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttc

SEQ ID NO: 6172 - DNA, 647 bp, Homo sapiens
tcggcacgaggcacgatctcagctcaccacagcctcgacctcccaggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaagtaggccttattttttcagcctaatagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtac

SEQ ID NO: 6173 - DNA, 614 bp, Homo sapiens
attttgttttttttcatttttctcaaaacatatatttacccctcctctcagtacatctttgagcacctttcccagaatctcaggaatgtatagacccccgccccacacttcatacccgccctaggccttggtgatgaggcccctcacagcttgtgcaatggcatccctgtcgataccaaacatcttcagcagctcagccggcttcccacttcttggtacccggttaactgccaggtgggtgacagtgatgccaggctcgcccactactgcactggacacagcctcaccaatgccaccttcataataatggtcctccacggtgaggatcctgcccttggtggcacgagcgctgtcgagaatgagttttctgtccaggggcttgatggtgaaggggtccagcacgcggatgttgatcttttctttcttcagcagttcggcagcggccaaggcctcgtgcagggtcaccccagccccgataacggtcacctggtcatccttgctcttcaggaccaccttggcttgtccgacctggaagtcctcattgttgttatagatgatggcattttctgggcggctggtccggatgaagcagataccctttgtattggcggcta

SEQ ID NO: 6174 - DNA, 115 bp, Homo sapiens
ccctgctcggcgtggccaccgccacctgcgcccgtcaacgacgagcccatcgtcatcgatgactatgggccggccccacctgcggccgcaagcttattccctttatgagggttaa

SEQ ID NO: 6175 - DNA, 585 bp, Homo sapiens
  misc_feature 440: n = A,T,C or G
tcggcacgaggagggtttcagaagctgccagaggaggagccagaaacagatctcagccccgggctcccagctgcccacctcataggtaaggacctccaagacctgaataagagtgtaaataatccgaaggttccagttctgctcgcccagagtccttcggctccatgattccagtgctcggtttcccacccgcttcacgaccttttgtcgctcgtgcccactcttacgctcgtccccgcagtgtagtttcttcttccctccggtgcaagcaaaagccggcctggaggtccccactacagcgttctgcaccccacatccgtgttccctcggcccccaactcgcactcatcccagaaacagcaccatccctcctcccccggcccggctcggctcccgcaggggctaaaagccgccacttccccagaagtcccaagcctttangatcgcattcccaagagcgcgtcggcccgtgtctccgcaggcgctccgctgaaggggcaggggctaggctgggagacgacgaaggaacaggcgtttctgacgagcgggacgcagttctcggacgccgaggggctggcgctcccgc

SEQ ID NO: 6176 - DNA, 581 bp, Homo sapiens
gcggccgcacgatcctaacattccaggtgtaagttacagagctcaagttcatctacaaaaaaagtaataaaaataaaatttaaaatggcaccttcatgttgccgtccaccccgttgtgctgctcgtagctgcgcttgcccaggatggtgggggagccgttgttgatgacgggggccaccttggcgggcgtcaggctgctgagcacgctggacacgcttttcacggggtcaggcttgggggggcgggggtgggtctcaagataccgaagcacggcttccagcggcttgcgtaccgcctgcttcagcaccagcgggctctgggaggcttcgggcagccgcgccgtgcactcggccttgatggcgcgctgttgatgggcaggtaggggtgccgcgagtgccacgggcgcaggatctcacggcacaggcgccgggcgatccgcgtcacttcgtcgtgtgcagatagaaagcctgcctggtcttcatggcaaacttggggctcccgctgctccgggctgggagggcgtggggactcatgttactgcggtttggtcctggcctctctccatctaaccgggttggaat

SEQ ID NO: 6177 - DNA, 602 bp, Homo sapiens; identical to SEQ ID NO: 1642
  misc_feature 173, 536: n = A,T,C or G

SEQ ID NO: 6178 - DNA, 135 bp, Homo sapiens
acacagatcgtccgatgcaacccaggcaccttgccccatggagcgctgcttgggaccgcccaccactccgggcccataccgaaacatctatgtctcaagcccaaaaggccatcttacccgactggggttggagtt

SEQ ID NO: 6179 - DNA, 376 bp, Homo sapiens
tcggcacgaggcggcggctgagaggcagcgaactcatctttgccagtacaggagctcgtgccgtggcccacagcccacagcccacagccatgggctgggacctgacggtgaagatgctggcgggcaacgaattccaggtgtccctgagcagctccatgtcggtgtcagaactgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgaacatcctggtgaggaataacaagggccgcagcagcaccta

SEQ ID NO: 6180 - DNA, 585 bp, Homo sapiens
ttcggcacgaggggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggagcggctgggtctgaagatggccaacgaggccgctgccaagaaccgggccaagaagcaggaagccttgcggagagtgacggaaaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttaaagccaggcctgggctgggctcatagacgcttcacag

SEQ ID NO: 6181 - DNA, 472 bp, Homo sapiens
gcgtcctctgagaggtgaaggagcactgtgtggtcagagggctgcgagctctctgtttgggttccgaggaagacagaatgggctgaactggaactgacctaaatgtcagcaagaggagtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctg

SEQ ID NO: 6182 - DNA, 462 bp, Homo sapiens
  misc_feature 376: n = A,T,C or G
gataggcataaacgtgtttattaagtgaaacgtatcctttaaaaataaaaaagggaagcctgtatataaatgaagttgtggattcaactagccagaatttattctgacttgcaccaaaccacacaaaatcttttaaaagtctagttagtgtagtctaaatggacactccagagtctgttcttgaattccattgcaagagctccaacttcctactttcagaagggatggggatcaagatgagggttgtcacataagctaattttcaatatatatcaagtcttgtggggtccaggaacaaatactgtcattggttagtgtttaagtacatgagttgacttttctcctctctcacaccccaccttgccctggcaattgngtagggggaggctgtttatcctccaagagaggacggctggttcctcatctcagtttccgttctaaaccacagagtggtcattgctg

SEQ ID NO: 6183 - DNA, 435 bp, Homo sapiens
ggagacctcagagtgtaaagaaaggtttactccttgtatcatcccctccccgtggactgcttcaattctattggggacaggccagtccctggaggctgcaaggagccacaaacctttcccagctcacactctgcacccctcagtctctgctgctaaagaatcagactcaggtagatggggtgtccacagtctgtcctcattacccagtcataccgggtagcatggcccgagagagcccttatctctccccaccttaaaaccctcagcatctcggcaagagtacacagcagcattgaccagtgagttggcctcggccaacagtaggaagtacttttctacagccaggacattgcaggactcacagcctaaaccatccaggagcagtaccacctggcctggtgtccagcagaccacgaacgcccccaggatgatgac

SEQ ID NO: 6184 - DNA, 522 bp, Homo sapiens
  misc_feature 343: n = A,T,C or G
tcggcacgaggaaagaaaacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttanttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctg

SEQ ID NO: 6185 - DNA, 440 bp, Homo sapiens
tcactagtaatctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagccatgactggcagctgggcggccactccgccctcccagggggaccaggtgcagctgaagatgctgccgccagcacaatgaaccccgagtggcacagaatccccagttttcccctctcatcccacagtcccttctctcctggtctggtgtatgcaaattgtatggaaaaagggctgtgttaatattcataagaatacaagaacttaggaagagtgag

SEQ ID NO: 6186 - DNA, 420 bp, Homo sapiens
gcccaacagacattttgctgctgctacaaagtctgcaaagaaaacaaaaaaagtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgca

SEQ ID NO: 6187 - DNA, 430 bp, Homo sapiens
ttcggcacgaggactttttttttttttttttttcccaccccacctttttttgttccacaaccctgtgccacccctaagggaattttttgccaaagggggggtaaaaaacctaagggccccttgggggaaaggccaaacaaagaaggttggaaccaccgggctcttttccaaataatccttaaaagggagccctcctaaccccccctccaggaaggggggggggcaaggggaatttcaggaatatgggctttaaaaatccagggggaaaccaaaaacccaaaagaattgggttggttccaatccccaaaatttaccataaaaatcccggcttttaactttcttataaaacaaatttgattcaaaaccctgtttgttaaccaggggaaggtttttgttttttgtaaaaccccagggggccccttttttaacc

SEQ ID NO: 6188 - DNA, 191 bp, Homo sapiens
tggtacgcctgcaggtaccggtccggaattcccgggtcgacatcatcatcatgatcgctcgacatcgatacgactttttttttttttttttttttttttggggggggggaaaagggggccccaaaaattttggattttcagggggggggtcaaatttaaaaaccccccttttggggttttttccaaaccct

SEQ ID NO: 6189 - DNA, 456 bp, Homo sapiens
  misc_feature 177, 400, 413, 434, 448, 456: n = A,T,C or G
aattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggccgttgtggtgcactgcagtcaggncattcggcaggtctggaaccttctgtctggctgatacctgcctcttgctgatggacaagaggaaagacccttcttccgttgatatcaagaaagtgctgttaggaaatgagggaagtttcgggatggggggctgatccagacagccgaccagctgcgttttttccttacctggggctgttgatccgaaggtggccaaatttcattcatggggggggattttttnccttggcaggatncagttgggagggagttttttncccacggagggacnggggaggn

SEQ ID NO: 6190 - DNA, 473 bp, Homo sapiens
gacagagggggttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctg

SEQ ID NO: 6191 - DNA, 534 bp, Homo sapiens
gacagagggggcagttacaggatcctggggagcagagtgtctggatggaacctgagctgggtctctgactcacttctgactttagttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtatgagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggcttt

SEQ ID NO: 6192 - DNA, 505 bp, Homo sapiens; identical to SEQ ID NO: 1649

SEQ ID NO: 6193 - DNA, 558 bp, Homo sapiens
cacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcct

SEQ ID NO: 6194 - DNA, 491 bp, Homo sapiens
gacagaggggactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaacagggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaagggctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccg

SEQ ID NO: 6195 - DNA, 152 bp, Homo sapiens
agaatgtatttggtgtctgccatatctttgcatccttcaatgacacttttgtccatgtcactgatctttctggcaaacaaaccatctgccgtgtgactggtgggatgaacgtaaaggcaaaccgagatgaatcctcaccatatgctgctatg

SEQ ID NO: 6196 - DNA, 543 bp, Homo sapiens; identical to SEQ ID NO: 1652

SEQ ID NO: 6197 - DNA, 564 bp, Homo sapiens
caaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgc

SEQ ID NO: 6198 - DNA, 520 bp, Homo sapiens; identical to SEQ ID NO: 1653

SEQ ID NO: 6199 - DNA, 575 bp, Homo sapiens
  misc_feature 313: n = A,T,C or G
tcggcacgagggcgagatggtggcggtgaaagccctcaagcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctanccgcgcgcaacgtgctgctggacaacgacaggctggtcaagatcggggactttggcctatccaaggccgtgcccgaaggccacgagtactaccgcgtgcgcgaggatggggacagccccgtgttctggtatgccccatagtgcctgaaggagtataagttctactatgcgtcagatgtctggtccttcggggtgaccctgtatgagctgctgacgcactgtgactccagccagagcccccccacgaaattccttgagctcat

SEQ ID NO: 6200 - DNA, 662 bp, Homo sapiens
gctctgctgctcctggggttcctgctggtgagcttggagtcaacactttcgattccaccttgggaagcccccaggagcataagtacaaagctgaagagcacacagtcgttctcactgtcaccggggagccctgccacttccccttccattaccaccggcagctgtaccacaaatgtacccacaagggccggccaggccctcaaccctggtgtgctaccacccccaactttgatcaggaccagcgatggggatactgtttggagcccaagaaagtgaaagaccactgcagcaaacacagcccctgccataaaggaaggacctgtgtgaacatgccaagcggcccccactgtctctgtccacaacacctcactggaaaccactgccataaagagaagtgctttgagcctcagcttctccggtttttccacaagaatgagatatggcatagaactgagcaagcatctgtggccagatgccagtgcaagggtcctgatgcccactgccagcggctggccagccaagcctgccgcaccaacccgtgcctccatgggggtcgctgcctaaaggtggatggccaccgcctgtgccactgcccggtgggctacaccggacccttctgcgacgtggacaccaaggcaagctgctatgatggccgcgggctc

SEQ ID NO: 6201 - DNA, 317 bp, Homo sapiens
tggatcccccgggctgcaggtcgagtttttttttttttttttggaatttttaacaaatcggtttaatgaagttcttattctggaaaaataatatcccactggggcacccttgttttttggtttggtccataatataaagaaccccattaccctttcctttaaaacaggcctttggatgttagtttttatcccaaaaaaaaaaccccaaacccaaaaaccaacccaccattccttaaaaatgtaggggaaaaaattaaggaaatccatttctttaggtaaaaaaattgggggttcaaaatccaaaaaatttaaaaacc

SEQ ID NO: 6202 - DNA, 579 bp, Homo sapiens; identical to SEQ ID NO: 1656

SEQ ID NO: 6203 - DNA, 106 bp, Homo sapiens
tccctttctgctgttcaccaccacccatgatccatctgtgtagtttctgaacagtcagcgattccaggttttaaatagtttgtaaattttcagtttctacacactt

SEQ ID NO: 6204 - DNA, 151 bp, Homo sapiens
tggatcccccgggctgcaggaattcggcacgaggttttgaagattatgccagtgcagaagcagacccgtgccggccagcgcaccaggttcaaggcatttgttgctatcggggactacaatggccacgtcggtctgggtgttaagtgctcca

SEQ ID NO: 6205 - DNA, 427 bp, Homo sapiens
ttaaaatattcatgccttttcctcatgacatgatatacaaatatcatgaagttaaagatagacaaattttactaactaaacaaactcatttttagcaaacaattgataaataccattaaaagacaaataacaaattagaagaaaatatttacatggtatatataacaaaaaattgatattcagaatgtatagagattatcaaataataaagaacttgcaaatcccagtgggaaaatgagcaaagaatacaaagaggaattgcacagaagaaaaagtatgcattatgtattaacaaatgaaaagttgcttcatctgtgtaatggccaaaatgtatgttaaaatataggacagcatttctccaatctcattggtaaactaaaaaatacatatgcacttcataaattcatatgtcacttcagcattttta

SEQ ID NO: 6206 - DNA, 562 bp, Homo sapiens
attgatgtgggacagcagccacaatgaggaactcctatagatttctggcatcctctctctcagttgtcgtttctctcctgctaattcctgaagatgtctgtgaaaaaattattggaggaaatgaagtaactcctcaatcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtggggcaggactcacaatagtgcatcttggtccgatactctgagagaagtcaatatcaccatcatagacagaaaagtctgcaa

SEQ ID NO: 6207 - DNA, 586 bp, Homo sapiens
  misc_feature 310, 360, 405: n = A,T,C or G
acaacgaggaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccangctgcctgagcacctcccagcccctgcccctcatgccaaccccgccctangcctggcatggcacctgtcgcccagtgccctggggctgatctcanggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatg

SEQ ID NO: 6208 - DNA, 367 bp, Homo sapiens
ccgaactcagcggaagactgtcctttccccgaaccctttcgctctaaggtactgaaggacctgccaagggtggaggggcggcctggagcctccctccctcccctggatctgcaggcactggacaaagagctggtacaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggactttgaggtggagctggagcggggcaagacgctgcacatcaaatccctggccgtgagcgacctgaaccgggccggcc

SEQ ID NO: 6209 - DNA, 503 bp, Homo sapiens
  misc_feature 248: n = A,T,C or G
cggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctanggccccccaagtgcctgcccctccccagagtattaacgctccaagagtattattaacgctgctgtacctcgatctgaatctgccggggccccagcccactccaccctgccagcagcttccagccagtccccacagcctcatcagctctcttcaccgttttttgatactatcttcccccacccccagctacccataggggctgcagagttataagccccaaacaggtcatgctccaataaaaatgattctacctac

SEQ ID NO: 6210 - DNA, 653 bp, Homo sapiens
  misc_feature 541: n = A,T,C or G
tcggcacgagcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcanggcctaaaagatgctggtcctcccaacctcactctcaaactccctgccaccttttcccctgggttctgccgtcttgcctcacttcccctcctgtcacatgctgacgttggac

SEQ ID NO: 6211 - DNA, 452 bp, Homo sapiens
tcggcacgaggggcacagccggggcccggccccaacatgggcaagggtggtagaacagatgcacgagaaatccatcccctacagccaggagacccttgtggttgactagggctgggagcagagagaagcctggcgccctcggccctccccggcctttgcccttgctttctgaaaatcaagtagtgtggctactccttgtcctatgcacatcctttaactgtcccctgattctgccccgccctgtcctcctctactgctttattctttctcagaggtttgtgggttaggggaaagagactgggctctacagacctgaccctgcacaagccatttaatctcactcagcctcagtttctcccctgtctactttcttgatctgaagggctactaagggttaaggatcccaaagcttgcagagactgaccctgtttaagctttctatcctgttttct

SEQ ID NO: 6212 - DNA, 621 bp, Homo sapiens
ctttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaag

SEQ ID NO: 6213 - DNA, 499 bp, Homo sapiens
tcggcacgaggtttaaatgggccatcattttatgaatcagtcattagagaggtttgataatcttctttaatgttaaagtagttcaggctaatcttaatacatgtatttttattgctgaccagtcttgaatatatactggtttgatgattgatttgcccctctaaaaaaatttgaaacatatgacattggctgttttagataatactttgtgtcattaatcatttttgtccaattttacaaaatatatgtcaatcttgaacatatattactttataatatatgttactttataatatatgttcaggtgaactcttaacatatttttttcagtgaactctgttctcttgtgggttacagtttactttcattaaaaatggaataggatttcttatatatataaaatataaaaaatatgtggcaccaccattccctatttatattttagttgtgatttaaaaatgagatttgactaaaacatttatcatacatgatcatccat

SEQ ID NO: 6214 - DNA, 549 bp, Homo sapiens
  misc_feature 46, 53, 404, 445, 476: n = A,T,C or G
gagaaaacagggaactttagtataaataagaggtcctgcgggacanggaggancctgaggggcttccataatttaacactcttcaaaagcacagacaatagcaagggcagctggggtgggggccgggcgagggctggaccacccccggccctgcccactcaactgaggggcacactgcagacctggggctcttgtggcaggggcggggagtctctccccaggagtgaccagtcacatgctggggacagggatgagggtaacactgatgtttcagaggaagaggtcattgtacttggcagtgggtgggggacaaggctgaggccacaagggctattacatcgcccgtgtccgggcccagtctggggggccccaaattttgtgcaggtggggggacttgaacagtncatccatcatggttagtcctgttaatacgttgatctgtgangtcagcaaggaaggttatggctaagaagctnggggcattgggtttggggggcccatatccatggcttcaaacactgtgcactcggggaatttcctgtttggaag

SEQ ID NO: 6215 - DNA, 631 bp, Homo sapiens
tcggcacgaggactaaactgtctcgaagactagacaggaaggaaaaccttgaattactctcacataattccactccagatatctcaacagaaatgcatacaaaaagctcctattactccctcaaaaggcatctgagaccgagaatacttacaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgttagcaagggacacaaaggcactctggtgtcctgcagaccagcgctcgatgccagaaaccagtgtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgaaagtgtttcgtgtgtgttgccttcctccacacccttcccccaggacgtccgcacacagtccacctcc

SEQ ID NO: 6216 - DNA, 568 bp, Homo sapiens
tcggcacgaggtctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtg

SEQ ID NO: 6217 - DNA, 573 bp, Homo sapiens
  misc_feature 348: n = A,T,C or G
tcggcacgaggcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccangaagagccagcaagagcaaggcatgggagaggggaggtgtcacacaacttggaggtaaatgcccccaggccgcatgtggcttcattatactgagccatgtgtcagaagatggggagacaggcaggaccttgtctcacctgtgggctgggcccagacctccactcgcttgcctgccctggccacctgaactgtatgggcactctcagccctggtttttcaatcccc

SEQ ID NO: 6218 - DNA, 464 bp, Homo sapiens
  misc_feature 15, 78, 464: n = A,T,C or G
ctggcgtgcggggcncgccagcaggccccgactattcgtgggcatgatcctgattctcatcttcgccgaggtgctcgnctctacggtctcatcgtcgccctcatcctctccacaaagtagaccctctccgagcccaccagccacagaatattatgtaaagaccacccctcctcattccagaacgaacagcctgacacatacgcacggggccgccgccccagttagttggtcttgtacatgcgcagtgtcctagtgcccatcgtctgtttccccggccttgcccccgcccgccccgtgccgtgggacatctgggcccactcatcgcccctccagggcccccggcgccccacccccttaggagtggtctgtgtatgcgggatggatttagaattgttcattttctctttaatgggatgtttatttattaaagatctgggctgtttcctgcgtctgggagggcccgn

SEQ ID NO: 6219 - DNA, 479 bp, Homo sapiens
agccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctctcccggacagacgccttgcccagggtgtgtttgctgagtgtcttgactaccgtgacaccacgcatggccagagctagcgtccctactgcctcccgactcctc

SEQ ID NO: 6220 - DNA, 505 bp, Homo sapiens
  misc_feature 392: n = A,T,C or G
ctgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccancacctgccagggcccgacctggggctgagtgcagaggctgagcaggacgttaggcccgggcccctggcacgtcctccaccggtgcctcctctggggaagggaaccagccctcc

SEQ ID NO: 6221 - DNA, 498 bp, Homo sapiens
tcggcacgaggttttttttttttttttttgccgggcccaatttttaattggggggggggcttaaccccccccccccgtaacacaatttggggttaaaaatttgggaaaaaggggaaatttaaacctttggacgggcccccaaaaattggggaatcccccccccaaaaaagtttgccccccctttggggcccccccccaccccttaatttggaatttccggaaacccgaacccccgggcccccatttggaaaccccccaaaacaacccctccaattggaaaaaaccccacaaggcccccaagggggcccttgcccgtttaatttcccaagggttggacttccaaagggagggagaattggcccccaagggagggtttttggcctttttttcccggtactggcgaaaccctttccccccaaagggggccccccccttggccccccccctattggccccggggttggggggcccgggcccgggggccaaggaaactttttt

SEQ ID NO: 6222 - DNA, 551 bp, Homo sapiens; identical to SEQ ID NO: 1665

SEQ ID NO: 6223 - DNA, 185 bp, Homo sapiens
atgttgggatgggaaactggagtatccaacttgtgcaaaaagatataatcaatcataaaatgcacacctttattcataactttagtattaaatcagttcttaatttcatttttaagcattgctttactcctttctattcatacgtaaaattttggattaattagcgaaaatgtaattataagctg

SEQ ID NO: 6224 - DNA, 577 bp, Homo sapiens
  misc_feature 306: n = A,T,C or G
cggaacgaggaggacactgccacaggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctangatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaagggcctcccagtctccccccaccacccgtgcacgacttcctcaccaccccc

SEQ ID NO: 6225 - DNA, 510 bp, Homo sapiens
cggcacgaggctgaattgaaacgggcaggaaatagtctggcagcctctacagcagaagaaacggcaggcagtgcccatggtcgtgcccaggaggctgagcagctgctacgcggtcctctgggtgatcagtaccatacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcaacccatttggacgggttggaggccaggatgcgcagcgtgcttcaagccatcaacttgcaggtgcagatctacaacacctgccagtgacccctgcccaaggcctaccccagttcctaacactgccccacatgcatgtctgcctatgcactgaagagctcttggcccggcagggcccccaataaaccagtgtgaaccccc

SEQ ID NO: 6226 - DNA, 522 bp, Homo sapiens
gcgctcaacagattgtccatggaaatgcagaaattaatttcttatgtctttcagtcccttctttccactgaaaatcctatggatgaaacaaaattaggtaaaaggagaaaaggtttgctcttgacccattccaccgcgtcctcctccccgcccacctctgctcatgcctccacgatcaaatccccctcttcccctgccccggttatcagggccactcatgctccggttctctcctggtccggaaaatcctccagactcctgcccataaacacccatgctactggggtggtcctgtcggaatgaacctgaggaaagagtcacatctgtaagccatggaccagcatttacaccactgcctgatgtactttctcctggaatcacaaaatcctcaattccaaggcactaaccaaggcaccatcttctttacatcacgataaagcatccttaataggtaggctcttttaagttcaacaaaactgctggatcatcacagctgaaataaccttatatagttagcctata

SEQ ID NO: 6227 - DNA, 55 bp, Homo sapiens
aaaagcgaaagaataaaaaccggcacatcccgactggcatgtttgattatgactt

SEQ ID NO: 6228 - DNA, 137 bp, Homo sapiens
aaaaggggggaaagaaaaccatttttggggttttgcctttttccccaattttaaaaaaaagggacccaatttaaataaaggccaaggatcctcctcctggccctttaaggggctggaaaatttttatataacttttt

SEQ ID NO: 6229 - DNA, 507 bp, Homo sapiens
tcggcacgaggtgctaccaatcacatgcctatcatatagtaaaacccagcccatgacccctaacaggggccctctcacccctcctaatgacctccggcctagccatgtgatttcacttccactccataacgctcctcatactaggcctactaaccaacacactaaccatataccaatgatggcgcgatgtaacacgtacaaattacataccaaggccaccacacaccacctgtccaaaaaggccttcgatacgggataatcctatttattacctcacaagttattttcttcgcacgatttttctgatccttttaccactccagcctagcccctaccccccaactaggaaggcactggcccccaacaggcatcaccccgctaaatcccctagaagtcccactcctaaacacatccgtattactcgcatcacgagtatcaatcacctgagctcaccatagtctaatagaaaacaaccgaaaccaaataattcaagcactgcttattaca

SEQ ID NO: 6230 - DNA, 540 bp, Homo sapiens
gtcagatgaatgacttttaatccagccccacaccccaaggtggcagaggagtgatgctggagcccggggcaaaatgctggggcccgggacacggctgaaagttccgtcgtgctgcttatttttgggctcctaggtgttgcgcacaaccagcgactgctccagctcctgcctgcgctgctggatcttgcagtagaagtagcgactgacggcctcctgggaccagggctggtggtagaactcagcccggcgctcctcttcagggttgccggctacatctgtcatcaccttgaggtcccggctctgggagcggacgaggtcttggacatagcctttggggtctctggagaagcttagcatgaagtccctctggatcttgagctggtttatggactcaatcgtctcatggatcttactgtccagagcactgatctcctgctggttggccgtggataggaggaagctgctcatctgcccctttaatggctcctccacctccacgtcaatgtcatagcacgccgtcttcttctggtctgaagggtc

SEQ ID NO: 6231 - DNA, 372 bp, Homo sapiens; identical to SEQ ID NO: 1668

SEQ ID NO: 6232 - DNA, 295 bp, Homo sapiens
acctaaagctggttatgctggcgaacacccctacccttatattgcgggtccccacatgcacacagaactctgacacatgatcagctgcacttaagaaatcatcccatctaacttcattattcctcatggggtggggagatgctgaaaggggtattgtatatcccactgcactgatagggctcactcaactggatttgagttctggaacacacattatccccacccctcccccaacgtgggctgaccattcttagtcctttctgaagtgggaccttctactttctgtgaacaccca

SEQ ID NO: 6233 - DNA, 465 bp, Homo sapiens; identical to SEQ ID NO: 1669

SEQ ID NO: 6234 - DNA, 309 bp, Homo sapiens
tcggcacgaggttttttttttttttggggccccaaattttttttttggaaggaatgggtccaaataaaaaaacttaaggggatgtttgggcccaccttataaaaagggaaaggaaacccccaacttgcttgccctgctttgggaaccaggaaatcccccccacggttttgggaaaattaccccaaggttaacttttatttatcactgtctcccagggggggcttgcaaaaaaaattttcccccaacccaaattggggccctccctttttgcccaagtgggccacggggccccccatttttttgagggtt

SEQ ID NO: 6235 - DNA, 102 bp, Homo sapiens
tcggcacgaggggcacgaggattgtacctgtggcacatcaatccgcactgtttgtactctggctgaatctcatctttaaccaacattgacaaaggacctttt

SEQ ID NO: 6236 - DNA, 549 bp, Homo sapiens
cggcacgagggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcgtcctccagctcgcccagcaacgagaacgccacaagcaactcgtgagcccacgtcggccgtcgggaaagcacg

SEQ ID NO: 6237 - DNA, 479 bp, Homo sapiens
cggcacgaggcggctcgaggccatggcaatgccttcttaaccaaaagtccttccccctttacaccacctcctcctcaaaaccttctcctcacggcacaagaaggcatctgccatcaccaccattgacacaagaagtggaccttaattccattggtgggccgcctgttcctccacgacaaaacacttctcaacatatgcctaaactccctgcgaaaacttacaaaatggagcacacacacccatccatgcacagagatggaccaccactgatggacaatgcccatacttgctgagttcctctgtactgggatgtatattaatcctagccccaaatccattgctagcaatggatgcactgaatgtgccagcactgaggagttaaaatgagaactccaaacactaacgactcttcttcaagatgcaacctaagacagtgaattgtaacctacatggaattatacaatggaaatggtattcca

SEQ ID NO: 6238 - DNA, 571 bp, Homo sapiens
tcggcacgaggcaggcagcacgtattagtaataaagggaaattttctacagataccaaagggaaaaccaacttctcggacacaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttgtctccctctcataaagggatagcagcccctcatgcaggagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctc

SEQ ID NO: 6239 - DNA, 606 bp, Homo sapiens
ttcggcacgaggcgcagccttgccgccacctttattgggcactcagccctgaggctctacacacacgcgccgggggatgggaggggatggggtgtcactcggggcagggaccctctggcgggaggacgggtggctggtgataagagcatggccccagggcccggcgccttggcccccggaacgctctgtgaccctcgcagctgacctggcctaagggcgtgcagagtcgtgacctggaccacccgtgggtgaactggctccccaagttctgggctcacttgggggcattgaagggcacggcccgctggttcatggggttgtcaggagagcggagccactccttcttgagcagctgtttcagctgcgacagccgcatgttggggttctcttgtttgagccgcggcagctgggcttcctcaaaggctgtgaaggctgcccgcatgcgtctttctgggtgccggtcggccgcctcctccgccacgctgagcactgcaatggcgtcctcgatggtgcgcgcctccacgctgccctcctccagcacgcggcggttcacgttctcctccagcggcacctccagatggctcttggctttctcggctgtgtccg

SEQ ID NO: 6240 - DNA, 497 bp, Homo sapiens
gtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaagatggatgtcacatgtacttcagtttgacgataaaagcagaaaagtgaaagatgcaagcatgcaagactcagatacatttgaaatctatgatcctcggaatccattgaataaaagaaggagggaagaaagcaaaaagctgatgagagagaaaaatgaaagaagatagtgtgagaataatgataaccagaacttgctggaaatgtgcctacaatggccttgtaacagccattgttcccaacagcatcacttaagggtgtgaaaagaagtatttttgaacctgttgtctggttttgaaaaacaattatcttgttttgcaaattgtggaatgatgtaagcaaatg

SEQ ID NO: 6241 - DNA, 592 bp, Homo sapiens
  misc_feature 532: n = A,T,C or G
tcggcacgaggctggtgaggtccaggagggagacccccgctactggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaagccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctanggccttcactctcccctgaggctgtcctggcccggactgtggggagcacctccacccccc

SEQ ID NO: 6242 - DNA, 476 bp, Homo sapiens
gcccagaacagatttatttttctttagataaagttcatacagaatatgttacagtcaggagttctcagctttcaccaaaaggtcagaagttattgcagttgtgcccagtggataggatggaggaagggaaacttctagaaagctgcctgtgttcagagaaggaatcgtcaatgtttaaagttgtggggctgccctgcaaaggatgttccagctccatccacagccagagcctccgaccgactctcgcctttccggatctccttgtagccaaggctcgggtgggggttcagcactacagtggggccttcttcctcggggacagcctcctctccagcctcagcctcctcctcctctcccccctcctcttctctctttgcctgccaccctggctctgcactcaggcccttctctctgtccaccagaccctgagagaggccctcctgctccagctctccgctcttcccaccccggaagag

SEQ ID NO: 6243 - DNA, 648 bp, Homo sapiens; identical to SEQ ID NO: 1671
  misc_feature 290: n = A,T,C or G

SEQ ID NO: 6244 - DNA, 636 bp, Homo sapiens
tcggcacgaggattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttcttctcaattcctaccacactgagggagcctcccaaataactattttcttatctgcagtattcc

SEQ ID NO: 6245 - DNA, 432 bp, Homo sapiens
attcggcacgaggtttttttttttttttttgaaaaaatatttacctttaaagaaacccccctccttggggtttaaacccaccaggacacaggccccccaaacactttaaattttttcctaacttttttggttaaaaaattggcccttaacaaaaacgggttgtttgggaacctttccttttccaaaaattttgtattaccccaatcgccccacttaattgaggggaccacccccatttttgtttttaccaaatttcccccgtgtttgttcattgcccaaagcccacattttgcaagggttaacagtggggcaaaaccttgggtccctttttaaggggaaaggtttaataccaattttccaaaagaacccgggggggttttggccaaatttaacccgggggggatgcaaaccaccagttttaccggggccgaa

SEQ ID NO: 6246 - DNA, 526 bp, Homo sapiens
tcggcacgaggagaaggagttgggggtgtatatctaactgtgtttttctatatggaaatatatgagcatcaagtgataacttcaataaggcctcaggattgtatttaaaatacctgttttgtgggacagcatgcctttgttttctttgcctgttggctttggtggctccaaacattttcattttacgctagctttcctgtcacccaggttgtgtgcattttttttttcatttgaactattgtttatcattattaatgatgttatctccaaatcccaaagccaaggaaatagccagtatgcaggacttgcagtaaatataagcattggtgttaacataggttaagttttgttagtgttcccagaaatatactgaattgagggataatgtagctttaaagaaattatgtttctttttaacatttggagaagccacctgtcctgggtccctattcttgagaaattcatcttttcatgcaaataacattgatgggggacaagactggatgattgacttctatcagtcagt

SEQ ID NO: 6247 - DNA, 504 bp, Homo sapiens
tcggcacgagggcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtact

SEQ ID NO: 6248 - DNA, 517 bp, Homo sapiens; identical to SEQ ID NO: 1672

SEQ ID NO: 6249 - DNA, 618 bp, Homo sapiens
tcggcacgaggggcccaggtagatgaggcctggagcctggctggccgggccatgctgctggaggtgcagggcacacccgttcgtggtgttagggctggcatgccaagtgcactgcggttgtccaccaactccttcctggtttccctgatgtggccgtggggctgttcgccttcccctttgccatcatcatcagcctgggttctgcactgacttccacagccacctctttcttgcctgcttcatgcttgtgctcacacagagctccatcttcagcctcctgtccatggccatcaacaggtacctggccagccacagtcggctcaggcataaaagtttagtcactgggacccaaacaagaggggttactgctgtcctctgggtccttgcctttggcactggactgaccccattcctggagtggaacagtaaagacagtacctctaataactgcatggagccctgggatggaaccatgaatgaaagctgctgccttgtgaagtgtctctttcagaatgcggtacccatgagttacatggtatatttcagttttggggggtaagtcctgcccccactgctcgtaatgtggctgatctccatcaagttcttcacagtgactgc

SEQ ID NO: 6250 - DNA, 586 bp, Homo sapiens
ctgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccaaagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgact

SEQ ID NO: 6251 - DNA, 615 bp, Homo sapiens; identical to SEQ ID NO: 1673
  misc_feature 84, 493: n = A,T,C or G

SEQ ID NO: 6252 - DNA, 474 bp, Homo sapiens
  misc_feature 165: n = A,T,C or G
tcggcacgaggcctcccgcacgctgggttgcagctgcacaggtaggcacgctgcagtccttgctgcctggcgttggggcccagggaccgctgtgggtttgcccttcagatggccctgccagcagctgccctgtggggcctggggctgggcctgggcctggctgancagggccctccttggcaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggtgagcctggcgccgccgtccaggtgccagcagctgctgcgggcgagcccaggacacagccaggatagggctggctgcagcccctggtcccctgcatggtgctgtggccctgtctcctgcttcctct

SEQ ID NO: 6253 - DNA, 501 bp, Homo sapiens
ttcggcacgagggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacagtctatctgcaggatggtcttcacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtg

SEQ ID NO: 6254 - DNA, 245 bp, Homo sapiens
  misc_feature 60: n = A,T,C or G
gcggccgcacgggggtgcgaggcgtctgtgggggcctgcgcttcggggcgagcgcacganaggctggcgcgcgccgatggaggatgctcactgcacttggctttcgttacctggtctgcccccgggctgggacttgtttgccgtcctcgacgcgatcggtggggctcgagctgcccgcttcggtgcacgccatttgccaggccatgtgctccaggagctgggcccggagcctagcgagcccgagg

SEQ ID NO: 6255 - DNA, 55 bp, Homo sapiens; identical to SEQ ID NO: 1675

SEQ ID NO: 6256 - DNA, 55 bp, Homo sapiens; identical to SEQ ID NO: 1676

SEQ ID NO: 6257 - DNA, 498 bp, Homo sapiens
  misc_feature 323: n = A,T,C or G
tcggcacgagggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccangctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgccccc

SEQ ID NO: 6258 - DNA, 121 bp, Homo sapiens
ttgccacgaacccttatacacctgcacatgcatctcatgtcatcttcactggaccctggattagcctacattcttcaacatcccatttgaattgtttaatgactaaaccattgagcattct

SEQ ID NO: 6259 - DNA, 83 bp, Homo sapiens
acgacagaaggggactcccgagctctactgactcccaacagagcgcccaagaagaagatggccataagtggagtccctgtgct

SEQ ID NO: 6260 - DNA, 462 bp, Homo sapiens
gtcgacactagtggatccaaagaattcggcacgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatct

SEQ ID NO: 6261 - DNA, 521 bp, Homo sapiens
catgctcaatattgatggctacatctacacctggtaccaagagccgattttggagaaagactcgctccacccatactggatctagctgcattggcacataccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctcctt

SEQ ID NO: 6262 - DNA, 381 bp, Homo sapiens
  misc_feature 8, 174, 292, 379: n = A,T,C or G
gccatggncctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgctnggttgggggccatccgggcaactcaccctggacagtcagcttgcggaatcggcagggccagcatttcttgcggggggtctctagtgaaggagcagtggatactgacttgcccggcatngcttctcctcctgccatatgcctcttcacgggctatgaggtatggttgggcaccctgttccagaacccacagcatggagagccaagnct

SEQ ID NO: 6263 - DNA, 387 bp, Homo sapiens
  misc_feature 299, 324, 380: n = A,T,C or G
atctcaccaatttcaaatctgatctattcggcttagcgactgaagattgacgctgcccgatcgcctcggaagtcccctggaccatcacagaagccgagcttcgggtaactctcacagtggagggtaagtccatcccctgtttaatcgatacgggggctacccactccacgttgccttcttttcaagggcctgtttcccttgcccccataactgttgtggggtattgacggccaagcttcaaaacccctggaaaactcccccactctgggtgccaattgggacaacattttttatggcantttttttagttattccccacctggncccattttccttattaggggccgaaatatttttaaaaccaaattatcttggttttnccggact

SEQ ID NO: 6264 - DNA, 53 bp, Homo sapiens
tttgttcatgtcagtgagagcttcccacaccctggcttcaacatgagcctcct

SEQ ID NO: 6265 - DNA, 574 bp, Homo sapiens; identical to SEQ ID NO: 1682

SEQ ID NO: 6266 - DNA, 477 bp, Homo sapiens
  misc_feature 1, 6, 12, 22, 221, 251, 267, 283, 288, 329, 361, 443, 465: n = A,T,C or G
nttggnttgttntgccttttantgaaaaggtaagatcatgtgattggaagaacacaactgttggcttgggaagaggactttgctgctgaagtgttttctaccttctgagtgtgtttaaggcaggatttggagggaaggaccagcttagggagagtgtctgagccacagcgtcaggatgggggaacccacatgggatccatcaagttccagttgaacaggancaagatcagaacttaggagggcagtgtcanctcccttgttggctgncaaggaacaccgatcnagtanaaacccacttggttgtgacccaggtacgaggtagatgccanacatttgagatatgcgtccttaaggaacctgnacaagcagactggaaggggatggtaagtgtgacagccttgataagttttctcaaagcccaggatacagagccagtgttttcnggtaactggagacctcagttangccaactttcga

SEQ ID NO: 6267 - DNA, 412 bp, Homo sapiens
tcggcacgagggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctcctt

SEQ ID NO: 6268 - DNA, 459 bp, Homo sapiens
atggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcaaaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggaggaactg

SEQ ID NO: 6269 - DNA, 517 bp, Homo sapiens
tcggcacgaggggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctgggcctggcgctgtcccctgagctgtcccattaaacacggccctgtctc

SEQ ID NO: 6270 - DNA, 437 bp, Homo sapiens
tcggcacgaggggagttgaggtctcggtggatgatgttcatggagtggaggtaggccatccctgatgcgatgtccttggcaaagctcactctctggctccatgggtactggctgtccatgctcttgatgatgccccggaacgtgccgcccttgatgtactcagtgatgaagttgagcctcttgtccttgtagagcaccccgatgaacttgagcacgttggggtgttccaggcatcgcatgaccttcacctccttgaggaacgtcctctgggtctcctcgtcgaaccggatcagctccttcatcaccatcacctcacctgtctcacggtgtgtcaccttgatagcctggccgaagcagcccttgcccagcacctccccgtggatgaagtccgacggccggaagatgcggtgtggccggcagactacgcggagggactc

SEQ ID NO: 6271 - DNA, 408 bp, Homo sapiens
  misc_feature 288, 311, 352, 385: n = A,T,C or G
ccagggatattttcacgtaacaaaaccccaacgatgcggcgaggggccacacacggcggtggaggggtggggtgggggttgggcctgccaggtgagattttgtctgcatcagtgcaggcgagaggctggggaagggggtgcctcttggcagactggccgggggcaggacctgaagaccctgaagcatggccgtgagacccatgggtgctccatcctgggctgccgtccatcgagacaccatggccgcctccgggcacccagcggcattccgtaccagcgaggggactnggctcacatcctgggggaggggntccaggggcagcagggcgttcctacagcaacagcattcctngggggggtgaacgggttggggaagggttggcancctgggggttttccaaagttttt

SEQ ID NO: 6272 - DNA, 177 bp, Homo sapiens
ctggataaagaacaggatatgaaaggcagaggacgctctcttgacgcattgcaagtccaggcaaaaacaattatgggttgcttttgaatgagaatgaaagtttatttttaatggaggtattatggaaaattccaagtaaagaactgagggtcatattgaccttgcctatatattcga

SEQ ID NO: 6273 - DNA, 423 bp, Homo sapiens
ttttaaattactactttattacattaatgttagctcttaatgttttgtattgggaggtttgacttaagagttgcaagtactaccaaatagccgaaaagaaagctgaagcacaatatttattagaatttttgaaagtgaaaaatgataaattatgccaatggactgacttctatttctcaatttattttctgttaagtacatgtgacataaaaaacaatacttaccatagtgaggatcttgacctaaaaggaactggtttatttattattctctctgccaaaatatactgctgcctcacagacacatatttttcatacggctatcttaagtataaggctgggtcaactgaactttaaatttatatgacacctcctgcattgattactatccttatttaaaaatcaaaacatttggtacctgagg

SEQ ID NO: 6274 - DNA, 455 bp, Homo sapiens
  misc_feature 4, 146, 157, 158, 161, 393, 413, 434, 442: n = A,T,C or G
gcgnccgcctcatgcaggaggtgaatcggcagctgcagggccacctgggcgagatccgcgagctcaagcagctcaaccggcgtctgcaggcagagaaccgtgagctgcgcacctctgctgcttcctggactcggagcgccagcggngcggcgccganncangtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggcccagcggcgccgggggatcaggagccgggccagcaccgagcttgcttgccccgtgcggccccngacctagcgatggaactcanatgcagcgtgggatcggatanttgcctgntgttcccgatgat

SEQ ID NO: 6275 - DNA, 687 bp, Homo sapiens
  misc_feature 635, 659: n = A,T,C or G
caaaagggaaccttgtatttcacaggcctcattttgatggcaaaaagacagggtaataataacataataataataaaaatataatactgaaaaggattgttcagggggagttggggtctcccgatcctgccatggctcggggggggctcaggtggctgcttaaggctgaaaggggggtctgaaatgaacctgcaaaataatccaagccgaccctcacctgctgggtccagggctaaagcctttgaaaatgctcccatggatcctggaactaggtctactgtggcagcaaggcacaggctgggggcctaaggggtcctggaggtcaggcaggtcacccagcaccattggggagtccatctggatctcacgctgcagggactcaatatcggcagggttcatgccatggccttcgagccagtcagcaagcagggaggctgagagagaggctgaatctgcctggccatcctgtggcccatcagccacgcccatgtcgaaagactggtttaagaattcctccaggtcaaagccaacaccgtagccagccccactgccctttggtgtgcctgagaacacagggggcagggggtcctccacctgtgacttaaatagctgctgggtcacaaggttgacatcangtgactctgacatggaaaactgangggctcccccggcgtttggggccgcaag

SEQ ID NO: 6276 - DNA, 838 bp, Homo sapiens
gctgctactgtgcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacgggctgcacccgccgaaggcctctgttgccacagcgagtgccctggcaactgttctcagcccgacgaccccaccaagtgcgtggcctgccgcaacttctacctggacaggtaagtgtgtgagacctggcccgccccgtactaccacttccaggacttgcgctgtgtgaacttagcttcttgcaggactgcacatcaatgcaagaactccggaggcaggg

SEQ ID NO: 6277 - DNA, 457 bp, Homo sapiens
tcggcacgagggactggaagcagaaaatgaccaaatcagtattttttttaatgaaatattattgctggaggcgtcccaggcaagcctggctgtagtagcgagtgatctggcggggggcgtctcagcaccctccccaggggtgcatctcaaccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgc

SEQ ID NO: 6278 - DNA, 440 bp, Homo sapiens
  misc_feature 332, 383, 406, 411: n = A,T,C or G
gttaaattacttcgaaactttaattacagatacttttccacgcaacatttctgaaatgaaagctttgattctcccctttttttgcataaaggctgggaaggtggtttggccagaccgtacatctttttgtatatacatatctacacctgtgtctcttctttattaataaaaggtgtcttgatcacagtcccaaaccaactctgcattgggattccagcatataaaactcagagggtaaaacaatttcaaagggaagacaggctgcaaccacagggaaaatgggcagggaaaagttgtaggcttgataggttgtttcttcttaaggtttaacntcagggaatattaattaattaatttaggggggaaaaaatagggggcccctngggtttccatcccctgctacccnacacngctcgtccccggactctgggggctgtctt

SEQ ID NO: 6279 - DNA, 449 bp, Homo sapiens
  misc_feature 382, 397: n = A,T,C or G
gggttccaacgccagtctggccgagtgcgttggcacctgcggaggtctgagagaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggcttctgggagacctgctgcacatcgtcattgacatccctatcaatgtctacaagctgctggcagaggactggccatttggagctgagatgtgtaagctggtgccttttcatacaganagccttccgtggggnattcactgtggcttgagtcttattgtggttcttgagtatttgacaggtattc

SEQ ID NO: 6280 - DNA, 663 bp, Homo sapiens
tcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatg

SEQ ID NO: 6281 - DNA, 499 bp, Homo sapiens
tcttccccacaacaatattcatgtgcctagaccaaaaagttattatctcgaactgacactgagccacaacccaaacaacccagctctccctaagcttcaaactagactacttctccataatattcattcctgtagcattgttcgttacatggtccatcatagaattctcactgtgatatataaactcagacccaaacattaatcagttcttcaaatatctactcattttcctaattaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttaacatgatttatcctacactccaactcatgagacccacaacaaatagcccttctaaacgctaatccaagcctcaccccactact

SEQ ID NO: 6282 - DNA, 457 bp, Homo sapiens
tcggcacgaggctggaagcagtccacccagcgcctgcgcagggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaattgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctcccctctccctcggtgacatcttgcccgcccctcagcaccctgccttgtctccaggaggtccgaagctctgtgggacctcttgggggcaaggtggggtgaggccggggagt

SEQ ID NO: 6283 - DNA, 566 bp, Homo sapiens
  misc_feature 361: n = A,T,C or G
tcggcacgaggctttgagtttaagaacttgtttgaaacctttaggcttgtttgttccatgggagagtcctcctgggattttgatactttgtgcatctttaaagaaaaggtttaccgtgtttcaccaaagctttaattgtccctctgtcccaagaattcagtgggtctctttatttaaaacaattgctcttttttaaaaggtgagagaaagcactcagaactgccttccatcttcccaaatggaaggctcacccgacagttgtatggaaccttctcatttacagagctgtggcattaaatcctcacagtcaccatgggggaacgaagccttatagggtgctgttcaacacagtagtcactangcacataagcctctgtgcattcatattcattaaaatgaagtcatctgtgtctcagttgcaccagtcacatttcaagtgctcaatggccccatgtggctactggcttccatattggacagtgcagacatataatcctgccatcatgataagaagttcaattggacagtgctgcattttaatacttgtcctacagagaattaaactg

SEQ ID NO: 6284 - DNA, 564 bp, Homo sapiens
tcggcacgaggggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaacagttccttaagaaccaatttaaaattacttcagtgcaatcctacacagtatcaacattagaattttgatattactcttatgttatcttccattctatttttatctgctttttgctgctaatttcaaactgccagtatttttccttttgcttttaaaatagttacaatatttttcatgatacccacagtattgccacaatttattataataaagggtttttatttgatttagcgcattcaaagcttttttctatcacttttgagttcagaatataacctttgtgtgcgtgtatgtagtgtgtgtgcatgtgtggcgtatatgtgtgttacaggttaatgccttcttggaattgagttaatgttctcttggtttattatgc

SEQ ID NO: 6285 - DNA, 603 bp, Homo sapiens
tcggcacgaggcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggaaggccagatacggccccgcccaaagggttctgcctggcgtcgggcttgggccg

SEQ ID NO: 6286 - DNA, 340 bp, Homo sapiens
tcggcacgaggttttttttttttttttgggggttggcagtttttttttttacaagtttcctttaaccacatggaattaacccctgatttccggaaccctatttaatagtggggaaacaataggcatcttttggaggataactttttttaaaacaccaacctcccctgaaaatttatggccgaaaaaattttgggccttatttttaaaaaatccattttttaattggaaaatttgatggttaaaatttggaaaagggaaggaacctctttgggacaaactcaaatttaacatattctgagggggggggacctttgccccaaatgatttttttcgggttacc

SEQ ID NO: 6287 - DNA, 350 bp, Homo sapiens
tgtacctgcagttatcaacacagttcgtccttaatcctcatgtcactgcttttggtgctgcctgttgtggaagcagtagaagccggtgatgcaatcgcccttttgttatgtgtggttctcatcattacaagcatttgtgcctgcttgggggtatatgcacgaaaaacaaatggacagatgtgactttgaaaggcctactgattcaaacctcaccctgaaaacctttgcgctgtagaggctaaacctgagctttggtgtgtgaaaggttccaagaatcagaccatacgggagtttcacatttttcattgtttccatgaaatggcaacaaacatacattgataaattgaaaa

SEQ ID NO: 6288 - DNA, 660 bp, Homo sapiens
  misc_feature 553: n = A,T,C or G
gacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaactcaaagctgccctctccgtgcaatgtcactgctcgtgtggtctnagcacaggattcggcgaagaaaacggatgcaccgctttagaacaaaatattcttcaagatttatctgtgttataatatattttgtgtcgttacattcacgtcgtgat

SEQ ID NO: 6289 - DNA, 587 bp, Homo sapiens
  misc_feature 119, 252: n = A,T,C or G
tcggcacgaggcggcacgagggggggaagttaagggggtcacctccattctggggaatttatatttgaattgaggctttggccttaacacccaggaacttttctattacaatcgcttangaagtaaagccttgtctccctccctgttctctgcctcttgtacccctctgacccacccgctctgccccactcccagccctcctcagccccagccctgcctgccctgcccctccagggggccatgagtgcctangtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaagactggcccatgggcaggcgggtggggggatgggaagggggtgccctgaaaccaaactggaagccccctctgcctcccagctggggcctctggggtggggtggggggctgtggtcaagccttattctgtatt

SEQ ID NO: 6290 - DNA, 633 bp, Homo sapiens
ttcggcacgagggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctct

SEQ ID NO: 6291 - DNA, 582 bp, Homo sapiens; identical to SEQ ID NO: 1694
  misc_feature 331: n = A,T,C or G

SEQ ID NO: 6292 - DNA, 487 bp, Homo sapiens
gccgcggtcttcctcgccgccttcgcgccgcctgggccactcagcttcggcttcgcgctcggctacagctccccggccatccctagcctgcagcgcgccgcgccccggccccgcgcctggacgacgccgccgcctcctggttcggggctgtcgtgacctgggtgcgcgcggggggagtgctgggcggctggctggtggaccgcgccgggccgaactgagcctcttgctgtgctccgtgcccttcgtggccggctttgcgtcatcaccgcggcccaggacgtgtggatgctgctggggggccgcctcctcaccggcctggcctgcggtgttgcctccctagtggccccggtctacatctccgaaatcgcctacccagcagtccgggggttgctcggctcctgtgtgcagctaatggtcgtcgtcggcatcctcctggcctacctggcaggctgggtgctggagtggcgctggctggctgtgctgggca

SEQ ID NO: 6293 - DNA, 585 bp, Homo sapiens
  misc_feature 327: n = A,T,C or G
tcggcacgagggttgatgatgggaggggccatggcaatggcctggccaggaaagtggggttgaagtagagaccttcccgcagtgacaccccggtgggtggctcgcagtagcccgtgagcagggagaagacgtagtcctcaccaccatgcctagctcgcacgatgtagctgaggtcagggggcaatgctccgttgttggcagctcgagcagcctcactgttggggtatggttttgggaaatagtcgaacagcttccctggccgcatgaacatctccccatcttcattggggccgtcttgaacctccacctccgcagccagctccttancttcatcctccgtgtagcacacgcccaccaggtggcggtaggccacgaagtccatgctgtggcaggaggcgcacacctgcttatatacctggaaacccctccggatgctggtgtggtccaaggaagaaaggaggccacggtgagaccacggatagctgggggggtgcagctccaggtcactggcactcacagccgaatgcagagccacgggcagccccgcaccccctgccgccagcatgcccagcgctgacagcatca

SEQ ID NO: 6294 - DNA, 477 bp, Homo sapiens
  misc_feature 392, 397: n = A,T,C or G
agctggtttcgccaaggcctttcaagtagagactctaggaccagtccgtgacaagcacgccggccggactgctccgggtcccagaccagctcgtgcgggccagagccggggacatggctagggagggatccccgggggcccggctcggccactctcccaccgtacgctggtcagtccgtgagtcagcagccggcgagggggttcgtggatatgctcaagccctcccacaagagtgagacctgtgagattatgcgtgagtctgagcggcctgtgcccccggcccggcccccctcacacagtgagtcagcagcatcagagccggctagccggccccctctccgctgccgccgaccgacataagccgagctgggccgcgggggcgagtaggcagngcggngagctttaccgatggagtggaggatgtcgatggaggcctcccggtcggtgctgagtagagactgggctctctggaactcc

SEQ ID NO: 6295 - DNA, 406 bp, Homo sapiens
tttcggtttaaatctttaatgcactggctggctgggcagcggcggtggggctgcggcgggggaagccacgacccgagcgctggggagtaggacccaggccgctggacagacagctcatcaggcctcgcagagtgccagcttctgctccccggggtgcgccgagctccgctccctccgccacatgcgaacgcaggggaaaaagtagaaacagccccagtagatctcctcctccgcctccagcgccacctcgtatctcctcattcccgacatgtcctgggctccgaacgtctcctggggagcggcatgattgaatcagggattccctagccccaggtccccttctccgtcattctcaggacgaggctgcccagttctcaggtaatctgaggctgatgccccgagaagc

SEQ ID NO: 6296 - DNA, 469 bp, Homo sapiens
tcggcacgaggatcgccgccatcatgggtcgcatgcatgctcccgggaagggcctgtcccagtcggctttaccctatcgacgcaccgtccccacttggttgaagttgacatctgacgacgtgaaggagcatatttacaaactggccaagaagggccttactccttcacagatcggtgtaatcctgacagattcacatggtgttgcacaagtacgttttgtgacgggcaataaaattttaagaattcttaagtctaagggacttgctcctgatcttcctgaagatctctaccatttaattaaaaaagcagttgctgttcgaaagcatcttgagaggaacagaaaggataatgatgctaaattccgtctgattctaatagatagccggattcaccgcttggctcgatattataagaccaagcgagtcctccctcccaattggaaatatgaatcatctacagcctctgccct

SEQ ID NO: 6297 - DNA, 494 bp, Homo sapiens
ccgcaggtctgaaatggactttaattggcttttgtctctagaattacccacccgttcctgcgctctacggttctccatgccccctccagtttgggggtctaaaccgaacaggagaggtgcaggggaccaggaggtgtcctggcacaaaggttcgggggtctccctggcaaggggtcccagggcctggagccgaggcccagccaaaagcacacagcatcaaaacatgtttttagtgggaagctccaggccctgcccctccccgggggcctcgaggatgtggagcaggtggaatcctgtctgcctccaggtcatggcagtgcaggcggtgagctgggggccagcaggggcgcggacagtgcggcgtggtcgaacagagggttgcgcacctccatttccccggtcggggccaggcccgggcactcgtacaccgtgaagtctccgtcctcattctcctcatccgaggaggccgtgtccagctcctctgggtggctctt

SEQ ID NO: 6298 - DNA, 332 bp, Homo sapiens
gcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggtcagtgcttcatcccatttgcagagcctcagacacgtcttggtggtgaggctcagttacccctgggcttaggctgaggcgggccctgtgctgggggtggtagaaaggatgctgctgaggc

SEQ ID NO: 6299 - DNA, 588 bp, Homo sapiens
tcggcacgagggggctgtaaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagatacacagggctgcgctgtctctggctgcagagcaatggaatacagaaaatcgaaaacct

SEQ ID NO: 6300 - DNA, 675 bp, Homo sapiens
tggtcttgatcccctgacctcgtgatctgcctgcctcagcctcccaaagtgctgggattacaggcgtgagccaccgcacctggctggcaatttataatttttaaaaggtgattctgattaccagccaagcttgcaaatcactggtttgtattgaaataaaagatattttcttgtaccagggctaaaatgtgggatgaaacattaaatctactagcctgaaaaaaaactttggcatttgtaatcaaagaacctgaaagttgccttgtgtgtttcctctgaagaatgctggagatttgtgatggataatgtttcaaaattcatgtgcctatgctttggaccatcaaagaagccattagtctctgtgtaaagaagaagtattcttaatggacagtcccccctaaccttataaattcagctttgcaacagatttcacctcctagcatgaaaattccaaaaactttaacaattactcataagtggatcttgagatgacattttcatcttggacaggttgaattctaaatctctacttcacagtgaatcgttttttaaatttttactgatggatcgttatttttcacaaggtactacattcttacaatgtaagactagatggaccaaaattttaaaaaaaacttcttgccttggttttttaattttcatatatattctatt

SEQ ID NO: 6301 - DNA, 566 bp, Homo sapiens
aaacttaccggctgagccatggttacaccgttaaggcgcagccgacggctgggaggcctaaggcccgaatcccccgagagcctcacctcagtttcgcggacgatacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagcgtcagcaagacctacacctggagtcgcctcaaagacagccagagtacagtcctgaatccccacgatgtcagccgaagccaagtgaggaggcaccaaagtgttctcaggaccagggagtactggcctcggagttggcccagaataggaggagctgaccccgggggccccccagcatcagctaccgccggtcccaggatcaccagagccttaccccggtcagcaagctcccggtccggagccctctcagccactactggagctgacaccc

SEQ ID NO: 6302 - DNA, 429 bp, Homo sapiens
ggtgagattgtcacagacttggctgaaacttaacaagaaactgtttacagcaacaaaggaagcaattaaagttaacatgatcattcaactgtgccattcatcatgcacttattgacatgctcaaaataggggaatgttaagtaaggaaatgaagtgggaacaggaacaagggagctaagccaagaggacttccagggacttgaacaaaaacaattcccaaccacatactacttttcaagcattttgaaactcttcttttcctttagtgatgttttcagtaacaaacttgcaagtgttcttggtggttaaaaaacaaaacaaaactacaagtatcagctgagaaagacaaagaaaaaactaagaatttaaattagataattccatttaaagtttccaattcctcgtttagggtgagttggaacattagaa

SEQ ID NO: 6303 - DNA, 476 bp, Homo sapiens; identical to SEQ ID NO: 1700
  misc_feature 372: n = A,T,C or G

SEQ ID NO: 6304 - DNA, 614 bp, Homo sapiens
  misc_feature 595: n = A,T,C or G
gggtttctagtgaatttaatgcatgagtctcaaaaatcaatggcaaaggaaaaaatgaataaaattaaaatggggtcaggagaaaagggccatgggcacacacaggaggggcagtcagtggctgagctaggagctgaagcaggggaattccttaggtgtcatatctcgtccaacccgtagtcctcctccgggaagtcccccaccgtcacgactgctggcttgacaaaggcgccatacttggcctggcattcgaagtagcgtttcccattcacactgccatcatttttccccagtggctcatcatagcggacaccaatccagtagccaggcttgaaatctgtgagacctacatacatgacggtgccccggcgaggggattgtcccgccgcccgcacctcacagcggctgcccacggggatggagctggcctgggccttctcctcggccaggcgctgggcggcctcggcctcctgctgagcccgctcctcctcgttgtaccggccgagcttgctgcgcttcaggaaagagcggaccgtgtcttgcctctggtcgtaggcttcttgtgagatcgtgtactttctcaaccgggacacgntctcatactcaccaaggcg

SEQ ID NO: 6305 - DNA, 536 bp, Homo sapiens
  misc_feature 153: n = A,T,C or G
tcggcacgaggcctcgtgccggtacatgctgaaaaacgttcgggtcctgggccactttgagaagccgctgttcctggagctttgcaaacacatcgtctttgtgcagctgcaggaaggggagcacgtcttccagcccagggagccggaccccancatctgtgtggtgcaggacgggcggctggaggtctgcatccaggacactgacggcaccgaggtggtggtgaaagaagttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgaaagccaggccatccctctcgtgtctgtagccagtgtggctg

SEQ ID NO: 6306 - DNA, 464 bp, Homo sapiens
ctcatcagagtactgggagatgagttcactgaagtcgatgcagatatccctttcctcagcttcctctcggaatttctcaatccccggccgcccatagtcgtcatcagctgcaattgtgcccacccagttccagcggaaatactcgatgatgtctgccatggcagtggcctggtgctcatcattggggatggttcggaggaaagacttgaattgattcttgttgctgaggagtctgctggaggaggcataactgacctggggaatgtagaagagccccagcagatttgccactgccgtggagacgcctgagccagttgctcccaccacagcaatcgtagagggaatgtgctctgagcagttgcagaactcatcaaggttcaaagaatcaattttgttttgagcaacaaaactcagggtggcttcaaggccttagaaacggtgttgcaagtgtcaaatatcatgta

SEQ ID NO: 6307 - DNA, 547 bp, Homo sapiens
acatttccctttcatgacatcaggtacggttgtatgactcccgactagttttaccatctgattcttaccttcccccccactgtattgaagaatgttggagatcttttaacacgtactctgtatattttgacattcgtacctaccagaaaacaaactttagattgttagttgttgtgttgttaccttcagctactctttggatatttcatgactggtgacaaaattcccatgtcctgggaaaccctgtcaagcgataaataattggtgactgttaaatttcgcaatggaaaaaattgcaactcaaagtttaggagtttggcattggttttagaggactaagagagaggctatgaattctcaaagatactaaacctgtaatgggatggacttcttgctctgttgaaaaggcctggtctctggaagatgaacttaaaaccagcttctcaaggtggttcatttaccacacatacttcagtgctcttttctgatttcatgtcccttatcaaggtttatgatttggggaccctcaagatttaagtgatcatgg

SEQ ID NO: 6308 - DNA, 731 bp, Homo sapiens
  misc_feature 517: n = A,T,C or G
tgaaagaattcatccttggtaaattaggctaggtcttgtggcaagaggcacccaaagctaatgaagaagagtaaatgatatttgaccgttacatatgtatataaggacgaaaaagaaaatataccaataaacatcttcatcaatatggaattaaatacatttacctattttagagatattttaagtatgctagtatcaacataatgagaatagtattttactgtctatttttaatagaaaaacatgtatatatacatatctatatatatttaaggagcaccccttcccccatttgagtatgattactcaatgggaagcagtaatacaaatggaaaaattcttcctcctatattgaggaaagaagataaaataagattgagccatgtttagcactgagtattttaacacatgggttttttgtttgtatgtttgttttgtaataccatacttcagattacaatacccaaaattctaaggtcctaatgttaatgatagtatctcaatgtccattttcggnttggttcaacatgattgtcttcttttgcctctgtgtcacacgtagtcattcccgctggaaggtgcacgtatttgatagggccttggtgttgagtaagaggatgtatttcgcgacatgaacagcatagtagtgcacctcccattaagcagagagtagcagcagtccatccagtgtagagagcctgacacatttctacctgcattgactgcggcat

SEQ ID NO: 6309 - DNA, 333 bp, Homo sapiens
  misc_feature 247, 289, 294, 324: n = A,T,C or G
aaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctngaagcagcaagaggaaccagtaagcttgtgggaaaggaattnggcanctctgaacccagggcacttttaaacttctnttagaaaag

SEQ ID NO: 6310 - DNA, 168 bp, Homo sapiens
  misc_feature 54: n = A,T,C or G
ggcgagaggactgagtgtgctgagcccccccgggacgaacccccggctgatggngctctgaagcgggcagaggagctcaagactcaggccaatgactacttcaaagccaaggactacgagaacgccatcaagttctacagccaggccatcgagctgaaccccagcaat

SEQ ID NO: 6311 - DNA, 230 bp, Homo sapiens
tggtacgcctgcaggtaccggtccggaattcccgggtcgacatcatcatcatgatcgctcgacatcgatacgacttttttttttttttttttttttttttccccggggggaaaagggggccccgaaaaatttggatttccagggggggggttaatttttaaaaccccccttttggggtttttttccaaccctttaaaaaaaaaaggggcccccttaaaaaaaccaaattt

SEQ ID NO: 6312 - DNA, 582 bp, Homo sapiens
tcggcacgaggtccagaatgacaagatgcggactggaaaccttccagccaacatgaagaagaaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagaactacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccg

SEQ ID NO: 6313 - DNA, 310 bp, Homo sapiens
cactagctcttaggtgttttcaatccctggcttctaaacctgaaaggacaccttttgcattcctcgcaagtcttttatttcagagccagagcctcctgctttgagacaaagccccatcacttcccttctccttccaagcctataaacctggtgccacttcgtgttgctccaggactccaccagggctcacttggtatggctgctcttgccttttcttggagtttgccgacccatgactaacattggaagtgagagaaatgagggcaggcatgagggtgtgtgttccacgtctgcagccctcctggccttc

SEQ ID NO: 6314 - DNA, 286 bp, Homo sapiens
tggtacgcctgcaggtaccggtccggaattcccgggtcgacatcatcatcatgatcgctcgacatcgatacgacttttttttttttttttttttttcccgggttttcccacccggcaggggaaaaaatggcctcccggcccccattttagggaggggcagggggtggaattcccccgaggaaccaagccttaaaaaccgaaaaaacggccccccttttgaaaaccccccaggggccccctttttgggtttttttccaaccctttaaaaaaaaaagggggccccctt

SEQ ID NO: 6315 - DNA, 289 bp, Homo sapiens
tggtacgcctgcaggtaccggtccggaattcccgggtctactactactaaattcgcggccgcgtcgacattgaatcaaactcttagacaagctggtgaaagttttaacgactgctggaggcaacatgcttccacactgacagaaatcatctttcaaaaatcctgcacatatctcaggcttatgaaacaaactaattcctaatagttggaaatgaattaaaagcttgcggtgagataaaagatagattttggctggatgtgatgactcatgcctgtgatccctacacttt

SEQ ID NO: 6316 - DNA, 464 bp, Homo sapiens; identical to SEQ ID NO: 1706

SEQ ID NO: 6317 - DNA, 517 bp, Homo sapiens
tgcaggtcgacactagtgggatccaaagaattcggcacgagggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagc

SEQ ID NO: 6318 - DNA, 492 bp, Homo sapiens
cagctgcagcctgcaattcactcccactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaac

SEQ ID NO: 6319 - DNA, 639 bp, Homo sapiens
gacagaggggcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcg

SEQ ID NO: 6320 - DNA, 641 bp, Homo sapiens
cccttttgcaataagaagccagatggataaaggaagtgctggtcaccctggaggtgtactggtttggggaaggtccccggcccccacagccctctggggagcctcaccctggctctccccactcacctcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatca

SEQ ID NO: 6321 - DNA, 552 bp, Homo sapiens
acagaagggggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacgctgacctggccccaccagcactctgggatttagctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgc

SEQ ID NO: 6322 - DNA, 395 bp, Homo sapiens
ttcggcacgagtcgagttttttttttttttttttccgggtcaaaatttcccccggctttttaaaaaaagggttgaatgggaaccttttaccaattttttccccaaattttttttttaaaacccggtttttaaagtccaccccaatttccctttagggattgttccaacccatttttttccttaccggcttattaaatttttggccttattccccattccccatttttggttttaccacctccttccctttcccttggaaaggccccttgcccttaaccacccttttgtttgcccccacttttggttagggcccaaaaaagggcccattttggggatgttccctattgaaaaaatgtttttcccccgggatcttttttttttgatctatttaaggg

SEQ ID NO: 6323 - DNA, 494 bp, Homo sapiens
cctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagcgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctct

SEQ ID NO: 6324 - DNA, 558 bp, Homo sapiens
ccctgtttgcaacaaagtatgctttaaaatgtaaactgtggagccattttccttgcgttgtccagaaggaacttcgtcctgcgtgacgctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtaggaggagctgtggagagttgtggagccctgcaagtgaagatgaaacctaaaataactcgtcctcccataaatgtggaaataatagagggattaaaagcagtcctaccatgtactacaatgggtaatcccaaaccatcagtgtct

SEQ ID NO: 6325 - DNA, 498 bp, Homo sapiens
  misc_feature 327: n = A,T,C or G
tcggcacgaggcaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccanggaggagctgcccctcagccccaccctcctcctgccttcagcccagccttcgacaacctctattactgggaccaggacccaccagagcggggggctccacccagcaccttcaaagggacacctacggcagaaaacccagagtacctgggtctggacgtgccagtgtgaacc

SEQ ID NO: 6326 - DNA, 372 bp, Homo sapiens
acgattttcactgctacatgcatgccatccatgccatgatcaatgcactctacaactttgccaaaggctccttcacccaaagtgtccacgatttcatcgaacgtgactgatgacttgaacagtgtctattgcgcttccttttaggactgcttctcctgctgcggactgaagatttactgcagtggattcgatacccgctttcaatgtctctgtgataatgtctaggaacatatccttcacagtagtcattcctgtattcgtcaacgtatctccggtcccgataatctcgctcattcaaggaccttgcttctaaataatgactgcaaacacattaaaagatttcaaattattctcttcattctgcaataatgt

SEQ ID NO: 6327 - DNA, 550 bp, Homo sapiens
tcggcacgaggggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagcctttctgggtgaggccaacgtgatgaaggctctgcagcacgagcggctggtccgactctacgcagtg

SEQ ID NO: 6328 - DNA, 488 bp, Homo sapiens
  misc_feature 79, 211: n = A,T,C or G
ccccatcaccttccgcatgaacgtggcgcctgcctgcctccccgagcgtgactgggccgagtccacgctgatgacgcanaagacggggattgtgagcggcttcgggcgcacccacgagaagggccggcagtccaccaggctcaagatgctggaggtgccctacgtggaccgcaacagctgcaagctgtccagcagcttcatcatcacccanaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactc

SEQ ID NO: 6329 - DNA, 454 bp, Homo sapiens
aagatttacatacacatgttatatcatagtctcctcacaacatgtctaagaggtaggcacgtcattgttcccattttgcagatgaggaaactgaggttcagagagggcacttggcttgcccaaagtcacacagcagggagtggcagaggaagtcaggttgggtgaccccagtaactgctctcagaggctgggtgatgaccggcttcctggcttctctggaataaacctttgccaccacttcctgcatttcagcttcagtacaggcagagaatggggataggtgggggaatgaggtgagaggggagatgtttagaggtgtggagggcggcagaggtttgaacagtgcagacaaggggagagttcagccgactggggaggaagaggatggacgatggagcctctgggcatctggatcagcaggagcataacatctggatcagctggagcgtatgac

SEQ ID NO: 6330 - DNA, 80 bp, Homo sapiens
gggcctttttatcattgatgataagggtattcttcggcagatcactgtaaatgacctccctgttggccgctctgtggatg

SEQ ID NO: 6331 - DNA, 449 bp, Homo sapiens; identical to SEQ ID NO: 1715

SEQ ID NO: 6332 - DNA, 499 bp, Homo sapiens
tggatcccccgggctgcaggaattcggcacgagcacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaagttggacagcccccttcggttacaggaaggcaggaagggtgagtcccctactccctcttcactgtggccacagcccccttgccctccgcctgggatctgagtacata

SEQ ID NO: 6333 - DNA, 478 bp, Homo sapiens
tggatcccccgggctgcaggaattcggcacgagcctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccgggtcacagcttcccttccatggtgt

SEQ ID NO: 6334 - DNA, 505 bp, Homo sapiens
  misc_feature 248, 384, 460, 465, 485: n = A,T,C or G
tccgctctgtcctgggtgaccagggtgtctgccagcacttggacacgtcagaccccaccacctcctgttgggttatctgcttttccctcttgggggggtggggagcatttctggagtaggaaaggactggggcatggggcggggtgcggagggcctggagagaggccatgggtcccggggctggaccacagcggggctgtgggaagggtcctaaccttcacaggcccccttcctggttaaggtttttnttttgctgaaagggccacaggatatatttgtggtgtaaaccccagaggctgccactgctttcctggggagcttggaggccacacccatgtgactgcagggcaggatggtggacttctaggcccctacagcctcggnagtgtcctcagatccggatgtggaaagtgctgaggaagtcaggggccttggaaatcatgtcctcgaagtagcaaanccaanttgccgtcacatccaaagtnacctcctcaatgaccttgtt

SEQ ID NO: 6335 - DNA, 549 bp, Homo sapiens
  misc_feature 140, 416: n = A,T,C or G
tcggcacgaggagagccccaggccagccctggtgagatccgcctccagtgacaccagcgaggagctgaattcccaagacagccccccaaaacaggactccacagcgccctcgtctacctcctcctccgaccccatcctanacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttanggaaggtgaatgtgttcccgtcctcccgcagtcagaaaggagactctgcctccctcctcctcactgagtgcctcatcctaccgggtgtccctttgccaccctgcctgggacatcgctggaacctgcaccatgc

SEQ ID NO: 6336 - DNA, 459 bp, Homo sapiens
tcggcacgagaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaagcagtctgactgtcctttctacttgaaagattacaatatgtatccaaatggcattcacgtgtcacttatcaaggtttgctgatgcttcaaacagcttagtttgaggtttcctggacgtggaaacaagtatctgagttccctggagatcaacgggatgatgtgttacagctgcctccctcttcatgcaatctggtgagcactggtgcatgcggcgagccatataaacttgccagttatataacttgtctttggcttttcttcatctgtaaaacaaggataatactgaactg

SEQ ID NO: 6337 - DNA, 484 bp, Homo sapiens
  misc_feature 245: n = A,T,C or G
tcggcacgaggatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatanagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacaccc

SEQ ID NO: 6338 - DNA, 495 bp, Homo sapiens
  misc_feature 365, 404, 428, 436, 451, 485: n = A,T,C or G
agtagagacagggtttcaccatgttggccaggctggtcttgaactcctgagcttgtgatccacccgcctcagcctcccaaagtgctgggattacaggcgtgacacctgcacccagccttaaggtcttataactagtaaatatctgcattaaagaacgagttgaatgaaaattctgataaattcctacttaaagtgtatccaaagaaaacggaaaaagtctaggagttagtgatattagattcagaagaatgagctttgtaattcttaaaaattagtctcagaatagaaaggattttaaaagtaattgagtaaagtcataggaaatgtgaccatataaaggaatggctctaaatgtattaatcccngaaggaagcaacaggttaaacagtaagaggtaagaaacnaaaaataaggaacgagagagaagngagtgacnggggagagagagacngagccggggaaggagagaatgggagggaaatccnggaaacgggg

SEQ ID NO: 6339 - DNA, 562 bp, Homo sapiens
tcggcacgaggtgctctctccatttgtcttaatttttttttaactcacttgtggcaggtctttattgaataaaggaggaataaacctagacagggagttagaaatgaaagacatttcaagacagttcaagggttatgttggtgacacttcttgtcttccagacagttttgaaagcacagatcttgcctcttgtgcttgttaaaaaatctgtgatacttctctgaagattttataattaaataagtgaaccattaccatgaccttttataaaagtgctgccctatttgaagtattgggttttttctcatgatgagctttgttagacttggtactgaaaaaatcagtagtttttttccttctattttaaaggcaaagaaatgcttgcttcagctaggcatggtggctcatgcctgtaattgggaggctgaggtgggtggatcacctgacgtcaggaattggagaccagcctggccaacatggtgaaaccccatctctactaaaaatacaaaaagttagccaggcgtgatagcgggtgcctgtaatcccagctgctcgggaggct

SEQ ID NO: 6340 - DNA, 144 bp, Homo sapiens
ccacgtcctaccacatgcccttggtccagcgtgcctcctcttcgcccagggcatacgaccttgcataagacagtggaatcagcctgtatgggcagacccctgggacgcacacctgggccctgctgctggctgcacttgcctgcc

SEQ ID NO: 6341 - DNA, 552 bp, Homo sapiens
  misc_feature 128, 473: n = A,T,C or G
cacgcttcctgctgcgggagacggtgagccagctgcaagcccttcaaagctcgctggagggggcgtcagataccctggaggcccaggcccatggctggcggtcagatgcagagagcgtggaggcgcanagcaggctctgcggcagccggcgggcaggacgccgagccctgaggagtgtcagccggtcatccacctggtcccccggctcttctgacacagggcgcagctcaaaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcacatcctcatggcccanaggcaggtccaggtggcagaagaaggcctgcaggacttccaccgagccctgcgctgctatgtggacttcacaggggccc

SEQ ID NO: 6342 - DNA, 248 bp, Homo sapiens; identical to SEQ ID NO: 335

SEQ ID NO: 6343 - DNA, 278 bp, Homo sapiens
tcggcacgagggttttttttttttttttttggaattttaaaaaaaaacggggttccaccatgtaaacaaggagggtttttatctccggaccttggaacccacctgcctgggcctccaaaagggcgggaattacaggctttggccaccgcccccggaattttttttttttaaaaacggatttttttttttgttccccaggtggaagggaaggggcccattttaatttaatggaacccccaccctccggggttaaaccctttttctggcctaacccccca

SEQ ID NO: 6344 - DNA, 544 bp, Homo sapiens
  misc_feature 464: n = A,T,C or G
accatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccangcctgtttgagcagcggaggctacagcaacaggttcccctctccatccccaccaaccgcctcacccagcgcatcatcccc

SEQ ID NO: 6345 - DNA, 419 bp, Homo sapiens
  misc_feature 157, 280, 380: n = A,T,C or G
cttccgtgcccaggtctgatacacctggtcccgctggtcctgcagggctcgaagctcttcctggacctccttggtgggtgtccctgcagcaagaagtgcctgctgccccagctgggtggcctgctgccacagcttctcccgggcctccagctccgcncggagccactggtgggcactgagcttcagcaagccactgctaggctcttgcgaactctcctccacctgcaggtcctggcgcacgcgggctgcccaggaggcatagtcacgcaccgccgtgganagcgggccaaggaggcgtgccgctccagctgggccctgcgctgctccatgcgtcgctgcagcactgcccacgcctgcgtcacagttgctgcctctgctgnaccgcatgggcctgaagcccggggacacagcttctggaa

SEQ ID NO: 6346 - DNA, 474 bp, Homo sapiens
  misc_feature 321, 410: n = A,T,C or G
tcggcacgagggagactccagcccccgctgcaaaccccccagcccctactgcaaaccccacgggtcctgctgcaaaccccccagccactactgcaaaccccccagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccanagatggatgcgcggcaggagcgggtggaggtgctgccccaagcccgggcctcctgggagagcctggacgaagagtggagggcgccccangcaggcagcaggaccccagtgcccagcacagtgcaagcaaacacctttgaatttgcggatgctg

SEQ ID NO: 6347 - DNA, 567 bp, Homo sapiens
tcggcacgaggcacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaata

SEQ ID NO: 6348 - DNA, 552 bp, Homo sapiens
  misc_feature 396: n = A,T,C or G
tcggcacgaggtccagcccctccaaacactcaaaccccaccctcccaggcactgactcccttccctgtagtcccccagtctccaattcctacactcaggcagaccctatggcccccagaactccccacccaagtcctgcccattccagtaggaaacccctcacaagctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcangaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcct

SEQ ID NO: 6349 - DNA, 503 bp, Homo sapiens
ttcggcacgagggccatgagccagctgcccctcttcggctacaccgtctatggggtgctgcgagtgagcatgcaggccctgtccggacccactctcctggggctcaaccgccagcatctcatcctcatggaccccagctcccaaagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgaaaggagtgcaggccggggagagaagaagatgaggcctcccccggcccaagtctcacccacatggtctgccttggatgctatcagatcactgttctagaacctgcctcagcacagcccagccggcccacatgcaggccatg

SEQ ID NO: 6350 - DNA, 581 bp, Homo sapiens; identical to SEQ ID NO: 1728
  misc_feature 133, 259, 321: n = A,T,C or G

SEQ ID NO: 6351 - DNA, 474 bp, Homo sapiens
  misc_feature 79: n = A,T,C or G
tcggcacgaggaaaacaacatcctgaaggaagggcggagctggcccacagccccctgcctgccaagtacatcgacctanacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcataacccccacccctgcggcctttgctcacgggtggccctgcccacccctggcacaaccaaaatcccactgatgcccatcatgccctcaaacccttctgggctctgcccgctgggggcctgaagacattcctggaggacactcccatcagaacctggcagccccaaaactggggtcagcctc

SEQ ID NO: 6352 - DNA, 570 bp, Homo sapiens; identical to SEQ ID NO: 1729
  misc_feature 431, 443: n = A,T,C or G

SEQ ID NO: 6353 - DNA, 159 bp, Homo sapiens
gcaacacccatcatcaccaaactttaccaaggtggtcctggcggcggcagcggcggcggcggttcaggaccctacgggggacccaccatcgaaaaactggactaagcttgcactcaagtcatcgtaaacctctttgcctttctctctctctcttttttt

SEQ ID NO: 6354 - DNA, 394 bp, Homo sapiens
  misc_feature 250, 287, 321: n = A,T,C or G
acagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccangtctttgggtacaggcttggtgggagggaagtcctanaagcccttggtccccctgggtctgagggccctangtcatggagagcctcagtccccataatgaggacagggtaccatgcccacctttccttcagaaccctggggccc

SEQ ID NO: 6355 - DNA, 215 bp, Homo sapiens
tgtactgcaagtaaaatttcactttttgaaactatagagagatccctttctgattagcctacagaacttaaagtgagggaaccatttcctctcacatacaaagaggcctgggatattacgactttggggtttgagagcatcatggggcagacagatggtggatggtctggacaagaagcgagtaagccactgcggttggtcatactgaagggaat

SEQ ID NO: 6356 - DNA, 457 bp, Homo sapiens
  misc_feature 2, 4, 16, 41, 43, 45, 47, 49, 186, 313: n = A,T,C or G
gncncgctacaggacnacgccctcgcgacgctgcctgtgcngngngncncacgctccgcatcagctcggtgtccacgggtctgcacagcctgtccaccttccgcggcctcatgaagcgcaggagctccgtgtgactgccccgagggacctggagcacctgggggcgcgggcgggggacccctgctngggaggccaggagactgcccctgctgccttctgcccagtgggaccccgcacaacatccctcaccactctcccccagcacccccatctccgactgtgcctgcttgcaccagccggcatgatggcggcntcttgaggacccctggggcccccatcggagccctgcaaattccgagaaatgtgaaactttggtggggtcagggaggaaaggcagaagcttgggagcctcccttccctttgaaaatctaagaagctcccagtcctcagagaccct

SEQ ID NO: 6357 - DNA, 588 bp, Homo sapiens; identical to SEQ ID NO: 1734
  misc_feature 95, 429: n = A,T,C or G

SEQ ID NO: 6358 - DNA, 381 bp, Homo sapiens
ttcggaacgaggcctcgtgccgctttttttttttttttccttttaacaaatttttttttcccgttttttatgggataaaaacttttaaaaaaactttctaacctacctttctttttaaaggaaagggatccaatttccaaatattcctaccctaacctttggctttcttttaaaaacccaattttctaaaagttggttttttttcctcaaaccaaaaatacccgggtcaacatttttaccgccccaacaaagggttgaaaaaccaaatttttttttgtccaaaattaaataacaaaaaaggtttcccttgcttttatttaaaaaaccaaaattttgatttccttagggattctaaaaaaaatttcccaggggggggggaaa

SEQ ID NO: 6359 - DNA, 507 bp, Homo sapiens
  misc_feature 428: n = A,T,C or G
acaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccgcagacaaccaggaggcccagcaaggccaccagcttggagagcttcacaaatgcccctcccaccaccatctcagaacccagcacaagggctgctggcccangccgtttccgggacaaccgcatggacaggcgggaacatggccaccgagacccaaatgtggtgccaggtcctcccaagcc

SEQ ID NO: 6360 - DNA, 474 bp, Homo sapiens
cttggactttataacaaaatactaaaagtgttgttgctgttggcctgggggcctgtacttggcccacgggacagatcagcttcccagcctcctgtaccttccacccgtgtgtgcacagacagtcattctcctcctcctgtccccatgtgtcctaaccaccccctcttcaagagctgactgccaagtccattccttcttctgctgggcacacacaggccacactatctttctgacggcctgcggaggacttttcatgggggatgatcctctagggggtgaaataaagcacatggcccacgctgggagacataaatcccacgatgttggatgtgtggctgcctctcttggggaaagggtgggtaccctccaacaactggacgctcacctgataagccttgccaaagccaggggctcccaacccagagtgtgtaagaatcccctggtggggtgggggtgggatcccaggggcttgtc

SEQ ID NO: 6361 - DNA, 443 bp, Homo sapiens
gtgaagccaccatccaggacgtgctgccacgacaccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcaacctgctgggtctcggggctgcccccctgcccccgcggctccccaccctcctccggcggcaggggctgctccgtggacgtgttctcagactcggcctctgtggtcgcgcctctcgctcctggctccgag

SEQ ID NO: 6362 - DNA, 483 bp, Homo sapiens
gaactcggcagtcctttatttagatcaatgcggggctgaggggccctcattccactgcagggcaaagggggaccaggcccaaggaggcctccttctgcccaaggtctggaggcagagaggggctcgcaggcggcccgagggcgcgcatccaggccccggagcgcaaagccttcctcccagggggaggcagtttcccatccaccgaccaggtttccccggagagtcccagcacaaaagcagcagcgggcggtggcctagaaggctcagagcgcacgcagggggacacaggcggggagctcactcctgggcgagcatcctcgcgaactcctcgtagttcacccgcccgtcctggtccacgtcggcctcgcggatcatggcgtccagctcctcctgcggcagcggctgccccaggcccgccatggcccgcctgagctcgtccacggtgatgtggccgtcgccatcctggtcgaaggcgcggaaagc

SEQ ID NO: 6363 - DNA, 528 bp, Homo sapiens
  misc_feature 417: n = A,T,C or G
tcggcacgaggctgaagactgtgattacatgcacctgccttagaaggtaggattttcttcccaggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttangcgtcacgccaaaggccagcctcctggccccaatacccattttggaagcccctgtggccgtgtggatgtcggtaacagttgtataaaataaattctatttatcgctattgt

SEQ ID NO: 6364 - DNA, 518 bp, Homo sapiens
  misc_feature 91: n = A,T,C or G
tcggcacgagggccgtggagccgcatccactgtggattataattgcaacatgacgctggaagagctcgtggcgtgcgacaacgcggcgcanaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgatgaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccatggcaccaccgaggcccgagacctgcattgtctcctggtcacgaaccctcacacggacgcctggaagagccacggcttggtggaggtggccagctactgcgaagaaagccggggcaacaaccagtgggtcccctacatctctc

SEQ ID NO: 6365 - DNA, 578 bp, Homo sapiens
  misc_feature 6: n = A,T,C or G
ggcacngaggggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgcacgacatcaccacagccccagatggtgactactggagactgctgcccccaggtatccacattgtcattgcccaagcccct

SEQ ID NO: 6366 - DNA, 527 bp, Homo sapiens
tcggcacgagggtggaagggagtgtaaaatacctcaaaaggtgtaggcatgggttagccgctgcagcccccactgtgcaaaccttaagggtgcatgtcttccaacagtggaggaaggccctgtcttcgccatgtgcatggcgggtgctcatgaccaggcgacgatggctaagtggatccagggcctgcaggagaccaacccaaccctggcccaaatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcg

SEQ ID NO: 6367 - DNA, 507 bp, Homo sapiens
ggtgcggcccagcagccacaaagctcccgctgccattgctccctgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggacccgccctcacccggaaaggcgcgagggccttggcggccaaatccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgca

SEQ ID NO: 6368 - DNA, 562 bp, Homo sapiens
attcggcacgaggctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattct

SEQ ID NO: 6369 - DNA, 655 bp, Homo sapiens
caaatcatcttttattaatataaaaagggcatatttagcaaaagacacacagataaaagagtcactatggctcaggacacaaggcagggaggtgccaggcctgtgcccctgctgggggagaaggaggctcgggacaaagtgggagaagtgctgggaagggctgagcggtaggggccacaaaagttccggtgggcaacactgtcggcaggtcatgggtgggactcatggggacctcgctgctaactcttgttgtgggggggtgtccttagtgctggcacctggagggccactccttggttcctggaggggacccaccaagggacacaggacaggaagcccaggatggttagtgcaactcgggatgaaggccagggagaagcgggtgctctgcagtggccggataggtccagacgctgaggccgaggcgcttcctgttacgtgcgggcgttccctctgtctctgccaggcactctctgactagggcgctccatggcgctcttgctgccagcataggtaggccggatctctttgcccatctcctctatgactgacagcaggtccgtgtaagtgctctgggagcccttggcgccgggtgcttcatcgcctgcacgtagcccatggaaggcggttcaaagtcgttaacagccggtctgaa

SEQ ID NO: 6370 - DNA, 471 bp, Homo sapiens
gaacccgggggtccgcctgtccttgtagtcccctatcccatcctggcctcgggagagactgccaaggagggcaagacgtacaggtgggggtcttggcgggatggggtccgagtgggcttggggctggggcttgagcagggctgctccaggagcccagcagcggggctgaaacaggacccttaggccgaggggcagggctagggtccagaggggcggggcttctggagagccccacccacatcccaagtcccagttcggggagggctgctggggaggggaatagaggcttggacccttaggtgtggtctgtggctggcagcacccccacagcctggggttgtgagagtcggtttcctcctccctttaagcagtgttctcaaccctggccaccttagaatcacctgaagaggccgtgcacaatggctcatccctgtaatcccagcgctttgggaggccaaggcgggtggatca

SEQ ID NO: 6371 - DNA, 358 bp, Homo sapiens
  misc_feature 91: n = A,T,C or G
gctttttttctagttttatggacttgattactgtaataatgtcttgtttttagccatgtaactacaaacagatattctcttgatgtcttantaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagac

SEQ ID NO: 6372 - DNA, 639 bp, Homo sapiens
  misc_feature 260, 521, 561: n = A,T,C or G
cggatccatcgatggatccgacaaaaggcatttcagcgcatcttcccacattcgcagcgaattcatttccaaagaactgaaagagaagcagcgcttggttcatgccatccgagaggatgatgaagttcaggttgtgggaggacactgtaagggttagcaaactgtcatagtccgcgtgtacgggacagctgtcatctgcatccagcgggtgcagtggggaaaggctaatggcatatttgtcatgtgagcgttcgccctancaaggtacggtggtcatggctaggccaaagctggacaaagcaaaaggaaatctgagtggaaagccacatctcaccaaacaagagaaaaagggcaaataggaagaaacgattgagatgcagaaatagggtaaccttacatacaagcttccaaaaacgaaacgaaggggacagatcggggggaagccaggtgagggggttcatgacttcttcggttttttttgggcggggtgggcggttacacagtttcgccctatcgcctangctggcgtgatctcggctcactgcaacctccacctcccangttcaagcgattctcctgcctcagcctcctgaatagctggggttacaggcgcactccaccatgcccggctaatttttt

SEQ ID NO: 6373 - DNA, 555 bp, Homo sapiens
tcggcacgaggaagtgagagcggaggcagggtcgctcagggttctacccacacgctgctgttggtcacccgggccccgaaccagcccttccagtagacggagtcctgccccccgtgctcgaagcggacgaagcggacgcccggcccgtagtcggtgaaggtgtgggagatctccatccagcccccgccgtcactgtcttggggcactgccacctgcccgctgctgaactcagccagcacgttctcgtgctcggacagtagcttaacggtgagctcgtagaggcaaccagcgtcgctgcggcccgagtaccagtccttcaccacgatggccggctgagtcgtgtccagcagctcctcccagtagccctcagcctgcaggtcaatgacctgtgctttgcgacaccactcaaaggaggaggcgaagtacttcttgacgctctcatcgtgggtgaactccaccccactgtctccaggcagctcctccaccctccagccgtccccaccatgctccacgtcacaccagccttccaagtcctcttccccacacgggttacgc

SEQ ID NO: 6374 - DNA, 544 bp, Homo sapiens; identical to SEQ ID NO: 1741

SEQ ID NO: 6375 - DNA, 669 bp, Homo sapiens
gagataaataaaggcctttatatacacagaagcatgacgcagcacgggcaggggggctggcagctgcagcagtgggcttggcaggtaaggcagggccaagtgctcctgtcaatgggagaagatcccccggaaccgggctttgtcctcttcgtccttctgccggatccgtgcctccagggcccgcagctctcggctcaccacaggcgccagggctgggtccagctccagcactttggcaaagtcagcctgggcctcctgggcattccacacggccgcgtgggcattgcccgctatgaagtaggccttgacgttgtcgtcgtacttgttgaggatggaagagcagtggtccagcacctcgtagtactcctcgaccaccagcttgcactggcagtagttgagcagcagcggcgtgatctgcttgtcaagctggatccattcaggggacccaggctgttccttcatctgcaggttcttgaggcaggcaatggcatcgtagtacttggcagcagcctccttcacatgcccctcgcggtacaaccggttgccctcctggtggataagtggcactgcatttgccttctcttcgtctgtcatggcccatgggtcctgctggtacgtggcagggctctccaccttcaacatctcccatgtgaaagatgagggggcggg

SEQ ID NO: 6376 - DNA, 517 bp, Homo sapiens
tcggcacgaggagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctcctcacatccgcacctgctgttcccactccggggttctcaagtccatgaacagatattgttgcattttccacaatgctgattaaacataataaacaatccagaaaagcagttttgcccag

SEQ ID NO: 6377 - DNA, 512 bp, Homo sapiens
tcggcacgaggttttttttttctgacagcaatagatttattaagtatccccgaaatataaacacaaaccagtaaaaaacaaaaccgtaaaacgtcaggcctggagctgcaataagacagaaacaggaccagctcacacgtggcctaggtggggaggacgaggccataaatactgcaggagggcggcaagggacccctagggcgaggggaaagcagggtgtcggcagcaaaatggctccgggggtttaaacactgctggcttcggccccggccgccacctgcctctcactccagctgcgagcagcttcacttggggccctgggcctccgactcctcctcgtcgtcttcgtacatctcgccctcttcctcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctc

SEQ ID NO: 6378 - DNA, 569 bp, Homo sapiens
tcggcacgaggccggtttctctgctgactgcagacccagtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaagaacgtgaccggctgcaactgaaagctctagaggaattaaatcaacaactagaaaaaagaaaagaaatggaagaacgtg

SEQ ID NO: 6379 - DNA, 472 bp, Homo sapiens
ttttattgttattatttatttttattttttacaaaacaggagaaaagagtgaatcgggttgggggaggtgacacatttctccacaaaggtacaaaattgcctatagaaagtcagcttcggaatgccgagcccaggctgctgagatgaggcgttcctgggcatccctctcccaaatgtccttcacatctggctggggtcactcccacattgagggcagccccccgaggtgagatggagtggcctccttcagcccttgcccaggaggcacaagagcaagcaactgagactgtacagagaaagagaagaggaaggggtgcagcccggggacacaggtaggggacagccaagccaggcccaggagcctctgggcagagagaagatggggaggcaggaggctctagccaaagtccctcctgttccttggagatgttcctcagaatggcagcagaggtgaccctaggaggtaagggca

SEQ ID NO: 6380 - DNA, 554 bp, Homo sapiens
tcggcacgaggcttattaaaatagtgatatttgctttactatttaaggtgtcactgataaattaatttgtacttctgtgtttaaaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcccgccattattaatttccctatataatgacgatacatgtgaacatttataaatggactaatactgcttgtctttcccccaccgcacaaaactggttcttaagatgccagcaatg

SEQ ID NO: 6381 - DNA, 457 bp, Homo sapiens
ctgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatg

SEQ ID NO: 6382 - DNA, 263 bp, Homo sapiens
gcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaaccct

SEQ ID NO: 6383 - DNA, 535 bp, Homo sapiens; identical to SEQ ID NO: 1748

SEQ ID NO: 6384 - DNA, 557 bp, Homo sapiens
ttcggcacgaggtttcacctttttgttatgtaaaaagtgcacgaaagctcggcagcctttgcaaaggtcagcagtgtttcctggggcgggggaactgggaggggccccaggcctggcacccagcttgcgactgaaggtggcctcgtattgcttagaaacgtatgtttcagtttaaataccagacagtaaaaatagagctcgaggaccacccgcactgttgccaaatcattgccagaatgaacagcttaaataaataaaaaatcgaaatatttacttctcgataaaaatcccagtaaaaccatttacctttctttgcattatatataatatacatttataacgggcctggctgcgggcggcggggccgagggcagcggaggggtcaggacacctcgatgacctccacgctgcccgagaagctcgcctgcttgcccagggcggccagctcctcgccgcgcgcgcgcccctccaccatgccctcctcgaactccatctggcagctgcggcgcttgaactgcgtctccggggccggctcctcgggccagccggtccgcgcg

SEQ ID NO: 6385 - DNA, 580 bp, Homo sapiens
tcggcacgagcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctgaagctgggcggctatgagccgctgttcaccatgagcgcccagcagccgtccatcatccccttcac

SEQ ID NO: 6386 - DNA, 605 bp, Homo sapiens
  misc_feature 411: n = A,T,C or G
tcggcacgagcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggnagctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatg

SEQ ID NO: 6387 - DNA, 543 bp, Homo sapiens
gggagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccg

SEQ ID NO: 6388 - DNA, 493 bp, Homo sapiens; identical to SEQ ID NO: 1751
  misc_feature 389: n = A,T,C or G

SEQ ID NO: 6389 - DNA, 555 bp, Homo sapiens
gacagaaggggaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtcttcacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacag

SEQ ID NO: 6390 - DNA, 68 bp, Homo sapiens
tactgtgatggttcgtgttggacgtggatggatggcacttgatgagttcttagtgaaaaatgatcctt

SEQ ID NO: 6391 - DNA, 377 bp, Homo sapiens; identical to SEQ ID NO: 1753

SEQ ID NO: 6392 - DNA, 503 bp, Homo sapiens
  misc_feature 78: n = A,T,C or G
ggactcagaagcttggaccgcatcctagccgccgactcacacaaggcaggtgggtgaggaaatccagagttgccatgngagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactgg

SEQ ID NO: 6393 - DNA, 517 bp, Homo sapiens
ggtcgacactagtggatccaaagaattcggcacgagggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctggg

SEQ ID NO: 6394 - DNA, 425 bp, Homo sapiens
ggggagaccagcgggccatgacaagttccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctc

SEQ ID NO: 6395 - DNA, 60 bp, Homo sapiens
acaactgaaataacaagtcttgatacacagaatatacatgaaatgttaaacaatgctgat

SEQ ID NO: 6396 - DNA, 601 bp, Homo sapiens; identical to SEQ ID NO: 1757

SEQ ID NO: 6397 - DNA, 401 bp, Homo sapiens
atagttgtcactttattataccatatcccttctgtgacctttcacaagtctgaaacaggtcgcagggacttcatggtgggtagttatttgcaatcaccgcattgatcgaggcgatgtaattggagacccgcgtgaagacggagggaatgtggcagtagttgcagccgcaagcgagacccgaagctcaggatgccgtgcacctggcaccggggcgtcagacccctgacagttcaatggcccgagagaatctccgtagcagctggagatcacgccatcactcggagaacagatcatactggttttcacgcagctggcccaccaggcatacccgcaacaagtggcataattcagaaccagcaaccggacctgctgcaggacatcaggaacagcccgttggtctg

SEQ ID NO: 6398 - DNA, 81 bp, Homo sapiens
tcggaaatgcccatccgtctccagtacatcgatgacctcctggaggtaccggtggtagtacaggcctgtgtcgggactctc

SEQ ID NO: 6399 - DNA, 588 bp, Homo sapiens
attgtacaccttgatggcgaggttaattaaatcctgttgtggagtttgagggccggaatttaatttttggagttttatttaatatcgggagcagattgggtaataaaatgtatattgagaataagacggccttttgaccttttagggtctagggctgtaaagtgtctcagggttgctgccgaacgagccatgaactgggctgggtttttatatttgatgaaaaagagcctaaacgcttctgatttgggataaagacaaaggagcattaaccttgactatgtctttagctccagccacctttttaagagtaaattgctgggcaggtgggggagggctagtcacggaacgaaactgtaagccggaccaggtgtgaggaggggaggtgataaaaagattacagggtggaggagtggagcctgaggaagaattgggacctagcttggcgtggagaggaggggagaggtcagatgggtttgtagaaaaggaagattagacacactcagcaacgcctggggttgggactgaggggacaggtgggagggaaagaaggaagatttgggaccaattgcactgggcacagagactagg

SEQ ID NO: 6400 - DNA, 719 bp, Homo sapiens
  misc_feature 537, 553, 567, 616, 678: n = A,T,C or G
catggacagcctgtattgaagttttattttttttctatacacgtgattgattaacaatataattaatgggatgtcattttataccctgacaagtttaaatgtaaataaattggcaccacctttaatcagactgatgtcctgacttgcacaggaaacacgcacctaacctcaccaacctcaagccctccctcctcaagtctccatgcaaagactgtgccagtcagagtggagctgtccccccgacgagcccccagaagcacccggccggccatggctgtcattttgagggcggaaaataactggatttctggttaattggtgacatcctcaagagctgtggcaagccatgtctcggccgcgtgatggggcagacatggtgggtcctgacggccttgtcttcaccaagtgctcctaactctcagcaaacttggggttcatgaccgtcgtggtggcgctcttgaaaaggggattatcattgttccactgggacttgagcttctccttctcaaagcgcctgtactccccgaggtcgctcangtggatcagagccttncagatgaccagcangagaatggcgatcagcacgatgccttgcacggtgcccccgacgatggcngcgatgttggggcctgcacacactctccgctctatccacatagatgaggtacgggccatccngtctgctgcttcagctgtaggcaccagcagcccttgagtcc

SEQ ID NO: 6401 - DNA, 391 bp, Homo sapiens
  misc_feature 62: n = A,T,C or G
tcggcacgaggcgagaagaaactgcaaaaatgaaggaacacaaagccatttgtaaagctgcnagggaaagaggttccacttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaatttt

SEQ ID NO: 6402 - DNA, 390 bp, Homo sapiens
tcggcacgaggcgaatggcggcggcagcgccttcagcgactactcggcctcagtcccctccacccccagcatcaaccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagctggtgacacacagcacctctggacatgccccctgtgcggggccggaggcgggccgggccctgggactgctctcacatgacaagcggccgcaagcttattccctttagtgagggttaattttatcttggcactggccgtcgttttacaacgtc

SEQ ID NO: 6403 - DNA, 356 bp, Homo sapiens
gttcaaaaaattttttttcttaacgttacatatcatagtgaatggtttccccagtgtatatgaatgttttaagtgtctccaatagcttatgcagtctatgagctttccaatactcatttaattaagatttaatcatttgctaatggaaatcttaccacctttcattttccctctgttaccaaatttcagctcttaggagctgctctacaattctgaatttgcttttcttgcctctctttactcacctgtcacaggaggttcctgctcagtaatgatattgtgagttaggataataactttttttttttgggcttcaaatttaaaaaaaaagatcctgtttccatttgaaaggaact

SEQ ID NO: 6404 - DNA, 495 bp, Homo sapiens; identical to SEQ ID NO: 1760

SEQ ID NO: 6405 - DNA, 600 bp, Homo sapiens; identical to SEQ ID NO: 1761

SEQ ID NO: 6406 - DNA, 445 bp, Homo sapiens
  misc_feature 400: n = A,T,C or G
tggcaagaaataaaggaaatcattgtggggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacgtgggctcacgcctgtaatcccagtacttgggaggccaaggcaggcatatcaacttgaggccagggagttaaagagcagcctggctaacgtggtgaagccccgtctctactaaaaatacaaaaaattggccgagcacggtggtgcatggcctgtaatcccagctacttggggagggcttgaggcacgagnttccttgaacccaagaggtttgaggctatgttgaggctgagatct

SEQ ID NO: 6407 - DNA, 549 bp, Homo sapiens
  misc_feature 15, 16, 34, 312, 378, 426, 453, 459, 464, 476, 483, 488,506, 519, 540: n = A,T,C or G
aggtcccttcccttnntatgggagctgttttcangctatttcactctattaaatcttgcaactgcactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattgggctaaaggcttgccattgttcctgcacggctaagtgcctgggtttgttctaattgagctgaacactagtcactgggttncatggttctcttctgtgacccacggcttctaataggaactattaacattaccacatgggcccaagnattccattccttgggaattccgtgaggcccaaggaattccaggttcanggattaggagggtttgccaccattttnggaagngggcntgttaccatttnggaagtnggttnaccaccattttggggagnttttgaggaaggnaccccccgtaacattttgggnaaccaggaa

SEQ ID NO: 6408 - DNA, 509 bp, Homo sapiens
  misc_feature 355, 423: n = A,T,C or G
tcggcacgagctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccanggcttgctgaggcccatccttttcctgcctctgggcctggctctgggcctcctctccccatggctcancgagcactgagctggccctacttccaggatggatgcatcacactcaaggacaggagcctggtccttccctgatggcctttggaccc

SEQ ID NO: 6409 - DNA, 459 bp, Homo sapiens
tcggcacgagacttgtgtcagttacctgtgagaggcacagcacaagtctttctgacttctcaagagtgtcccaaacaagttagggttaaggattacccatgcttccatggagaagggtgccttacggaagaggtcttgacttctcagtgtggaagaaccttccaggtctcacctcttactgcttgaaggtccttggggtttcctactgagctctgcctctcctccttctaagaggcaagctgcctcacccaggccagggccgctctaaatgcagcctgtggacacgctttttgcttcctgttctgctcagcagtgctttaactgggcagtgtgttactggattgatgattgaccaatactgcacacctcatcgttagcaaacacctggaagcttgtttgcagggcctggcttttctcttgtctccaacaccctagtgcatgtgctgtgtcactatcatc

SEQ ID NO: 6410 - DNA, 492 bp, Homo sapiens
ttcggcacgaggggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagtgcagatacaagcagaaattccagtcagtgttcacggtcactcggcagacccaccagccccctgcacccaacagcctga

SEQ ID NO: 6411 - DNA, 307 bp, Homo sapiens
tcggcacgagcggcacgagattaacaggtgctaaagtcagaagcagaaatttatgaagcatttgaaaacatctaccctattctaaagggattcaggaagacgacgtaatggctctcatgtacccttgcctcccccacccccttcttttttttttttaaaacaaatcattttgtttgggtaccttaaaaggggggtgttgaaaaaaaatggatgttgatttgcagggtgtggcaccaggggatgcccttctgtaagtgcccaccgcggaatgccggaaaggggctttatttgggcactgaaaacaccg

SEQ ID NO: 6412 - DNA, 462 bp, Homo sapiens; identical to SEQ ID NO: 1764

SEQ ID NO: 6413 - DNA, 225 bp, Homo sapiens
tcggcacgaggcttctgtatttttttttctaagagaattattttctacagtggttttatactgaaggaaaaacacaagcaaaaaaaaaaaaaagcttttttctaatttatctaaaccctaatttctcctcctttcttttcccttgtttcaagaaaactccacttttgctttaaaaccaaaaagggtttcctttaaaacccaaggaaagggggggcttttataaag

SEQ ID NO: 6414 - DNA, 431 bp, Homo sapiens
  misc_feature 1, 276, 277: n = A,T,C or G
ngtctgaaatggcttccccacaggacatttttaaatgattcttaattgcagggtagccaagtggagtaggtctgttgctggcacgtgaatactggctgaacctgtgcaatgtagtaattgctaaagttggcatctgctacatagggggctggctggtaatagcaagtgacattagccacattaggaatgacattttggtcagctaacacccggatagccagcatggtgataaggtttaaagtctgtcttctttcatgtcccatcaggcacactgtnntcatcatttaccactccatgaagggtcatgagatactcatacttgcggtcttccaatcccacaaagtggttctgcaaataggactccagttttctctgctgctctacaatgtctgagaagtcgatgaaaaacctgggaacacatatacctttga

SEQ ID NO: 6415 - DNA, 465 bp, Homo sapiens
tttgactggaaagaaattgggatttttattttagtaagtaagttggtcaggcacaagggcgactcagcagagggaacttcaaggaagtgtgagacaacagctggagccctgagctgggagagtggaggacgaattataaagagttttatgcctgccataatgagaagcttgtccttgaacttgaggggaatgctgagagtgcaaaggactttaagcaggccctacacagtggcagccaagcaggtcataaagagcaagatgatgcccaggcagatcagggattctcttatctacagagcgtccgcctaccagctccttcacagcagcggattttgctgcaagagaagaggcagcaggccaggccttttccttcgcccacagcgcctacgtcgaaggctcccaggctggttgctccactggctgcttgaggtcccctctctccagacccgccgaactggggccggg

SEQ ID NO: 6416 - DNA, 534 bp, Homo sapiens
  misc_feature 74, 400, 412, 448: n = A,T,C or G
cggcacgagggcagactttctgagccgggttttcttttagtggaaacaaatggttgatggatccagatccttanaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcangcagggccccanggtggggtgaggaggttcctgctctggcaggtctangcggaagggagtggagatggggctggttcctgctgcagtgaggggaacagatgggacaataaagactggagactcagttgaataat

SEQ ID NO: 6417 - DNA, 562 bp, Homo sapiens
tcggcacgagggacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaagaggctccagcagtgccctcagccccaccctcctatgaggaagccacctctggggaggggatgaaggcaggggccttccccccagcccccacagcggtgcctctccaccctatctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctgga

SEQ ID NO: 6418 - DNA, 123 bp, Homo sapiens
tcggcacgagggcggaccagcggagcggaccccgacagctgctgaccctctataaccccacagaactgcgcttcgcttccgagtcctgtgcacagcacctgccaaatacacggtgtttgacgc

SEQ ID NO: 6419 - DNA, 559 bp, Homo sapiens
  misc_feature 495, 504, 516, 522: n = A,T,C or G
catctgaagtgggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagccgtgaagaggagctgggcaaggtgccaagtggctgaantgccggcanaagaggtgagantgcaanctgaggtgccattcggcagcacaggacaactctctgc

SEQ ID NO: 6420 - DNA, 485 bp, Homo sapiens
  misc_feature 329, 389, 401, 472: n = A,T,C or G
atgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgacttgggagccgcgaccggacagtgaaggagtnggacctcggccgtgctatttctccagggaccattcaatgttccttttcctactgtaattnacgttggttttnttggggaccatattcattcatttagttggccacaattgacccagaaagattcccgtttttttggggacaancaaggggggcccc

SEQ ID NO: 6421 - DNA, 529 bp, Homo sapiens
tcggcacgaggcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacagcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactc

SEQ ID NO: 6422 - DNA, 450 bp, Homo sapiens
  misc_feature 1, 4, 55: n = A,T,C or G
ngtntcctgaatgtggaccgtgtggctgagcagctggagaagctgggctacccancatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctct

SEQ ID NO: 6423 - DNA, 572 bp, Homo sapiens
  misc_feature 402: n = A,T,C or G
tcggcacgaggcgcatcccctccctgtctttgtggattggcctgtcctggacatttcatagaaatgggatctcacggtgcgcagccttctgtgtctggcgtctctcactgagcgtgacgtcctcaggtgcgtcctcaggcgcatccgcgctgtggcctgcgccagcctcgctcctcttcctggctggtggtcccaccgcgtacacgtgccgccgcctgttttgctgctgcttttgagctgagaattgtttttatgacttttaaatagctagaaagggatcaaaacaagactgtctcacgatgtggaaattacatgaaattcacagttcagtgcctgtgagtagagctgaccggccgcagttcagccacacatggactcattaccgaagctgcctccacccangcagcctgagccagcagctgtgaccggcaccctgtggcccacacggccagaagtgtttgccatctggccccccgcaaacgcggtctgctgcctgtggtggagatcactctggaggcggctgtcatcggccactcccgggagccctctcctaccctcagtcctccatccct

SEQ ID NO: 6424 - DNA, 658 bp, Homo sapiens
tgcatcagtaattttaatagagactcttagtggttatcaacaactggtcagttgttttttgttttttttttccacactgctctctggattcgaacctagtgaattctgggctcagtcctcctcctccatctctttcttgatccagtccacgtagttgagcactttggtgtagaagccatagcccctgctgcacccgatgccccaggacacgatgcccgtggccacccagcgatcagtgttcgggtcccttactgcaaaaacgcccccactatccccctggcaggcgtcctgctttagagatgggtgtccagcacagaacatgttttgagagaacacatccatcctattctttccccggagccagttctcacaggcctgtggattagctacgggcagacggacaaacctgaggtcatgagcaatcttctcctccatgaccccgaagccactgacatagcccatcaagcccaggtcgtagaaggtatcgttgtcagggaggcagatggggaggaggtttgggaccagggtgacactattttccagcttcagcaggcgattgtcccctcaaaaatgtaggaatcatcttgacgtagccgggttggcgctgaccttgcgatggggggattcctagctttatagctctttcaattgtgtggcc

SEQ ID NO: 6425 - DNA, 515 bp, Homo sapiens
cagtctttggggctgtcctgcacccctacacctgggccgcctgaccttggactgacctcccgttgcctcctggagccctgcataccttctgtgccacaatgcctgccgtctcccgctaatgtctccagctgcctggaacaaatgtgggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcggctcaagtctttcgttttcccaggctaggtagggctgtgaggaatgcattaagagggtttgggagtttctgaga

SEQ ID NO: 6426 - DNA, 233 bp, Homo sapiens
tcggcacgaggttttttttttttttttttgccggcagcaggaacttgtttttttttaaccaggtgggccctttcggccaggggttgaaaccacaaattggggggggttgtcccccacaaggcccgccctagggaggcaggtttcggccctaaaaaaccctccggaaggaatccaggtgtccgggggtaaaggagggctttattttttccgaaaaataagccttttgttgtggg

SEQ ID NO: 6427 - DNA, 535 bp, Homo sapiens
tcggcacgaggcctcgtgccgagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 6428 - DNA, 450 bp, Homo sapiens
cctcgaggccaagaattcggcacgaggtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagctgaagaaaagtttgttaattggatgcgatttttttttttcacgttacaagacatgaagaaattttaaaagataaacatctatattgtgaaccatcagctgaaaagataaatttgtgttcaatatataggcaaaaaaaaatttgtgttaaaatggtgaatggaataataatgaggaaactg

SEQ ID NO: 6429 - DNA, 455 bp, Homo sapiens
attcggcacgagggggagcgggaggcccgccgtggacaggcccactcaccccgtaggtgatgagcagggccctgggtttgagcaggtgtcctgctgctctgaagagcccctggtgagtaggaacaggacggcagtgaggtgctgcccccaacagaagccaggccctgaggctggagaccctcaccccgactgtgatgggggaggctggagaccctcaccccgactgtgatgggggaggctggagaccctcaccccgactgtgatgggggaggctggagaccctcaccccgactgtgatgggggaggctggagaccctcaccccgactgtgatgggggcaaatctggcatcccagctgcccccatgcagggtgagtggtgccacggcagacacccatgctgggctccccacagacctccgtgcagcgcagggggctgacatgggccatgttgatgc

SEQ ID NO: 6430 - DNA, 546 bp, Homo sapiens
tcggcacgagggtaatttcagcactttgggaggccaaggcaggcggatcacttgaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattgtggttttttccaattctttacttttgatactgtgaagatctttcgtgccgaaagataaagcaacatttggacacag

SEQ ID NO: 6431 - DNA, 408 bp, Homo sapiens
cggcacgagctgaatagctgggactacaggcgcgccaccacgctcagctaatttttgtatttttagtgaaatacgaaaattagttttagcgaaacggggtttcaccatgttggccaggatggtctcgatctcttgacctcgtgatccacccgtctcggcctcccaggtgctgggattgcagacatgagccaccgcgcctggtgaaagttaaaaatcttaaagcaaccagtggattgagacacattatctttacacaagcaagaaaaaggctgggcgtgatggctcatacctgtggtcccggtactttgggaggctgaggcgggatgattccttgagcccaggagttttgagaccagcctggtaacatggtgagaccttgtctcagttttaaaaatttattttcttatt

SEQ ID NO: 6432 - DNA, 544 bp, Homo sapiens
  misc_feature 333, 373: n = A,T,C or G
tcggcacgaggtgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctgtggcgagggctgtgccgagcgcaacaggcccggggtctacatcagcctctctgcgcaccgctcctgggtggagaagatcgtgcaaggggtgcagctccgcgggcgcgctcaggggggtggggccctcanggcaccgagccagggctctggggccgccgcgcgctcctanggcgcagcgggacgcggggctcggatctgaaaggcggccagatccacatctggatctggatctgcggcggcctcgggcggtttcccccgccgtaaataggctcatctacctctacctctgggggcccggacggctgctgcggaaaggaaaccccctccccgacccgcccga

SEQ ID NO: 6433 - DNA, 544 bp, Homo sapiens
cagctaaattaccctcactaaagggaataagcttgcggccgccgactccggaggccggtagggactgctcgctgccagggggctcggtgcccaccgtggctggtcttcatgctcaaaattttcatgtcactggtggtggggatcaccaccggcgtctgggtgtggagctccaagactttccagacctggcagagcctgtgctaccgcaagatagcagctggccgggcccgggacaaggcctgccgcgcccccgggagctacggacgtggcacgcactgccactataaggctcccaccgtgctcttgcacatgactaagacggacccctctttggagaaccccacacacctctagccacacaggtctggcgcggcgtggctgctgccccctccttgccctccacgccctgccccctgcaccccctagagacagctgactagcagctgcccagctgtcaaggtcaggcaagtgaccaccggggactgatgatcagggcggaaccccgtgaggctcattaggggagatgggggtctcccctaatgcg

SEQ ID NO: 6434 - DNA, 457 bp, Homo sapiens
  misc_feature 455: n = A,T,C or G
caagtgtagtcacagtttatttctgatgtggctgaatctagggacaggcgggctgggctgagtggggggcgtgtcggcgatggggctagaactccaccttgcaggccgggaagggtcatcctgcatggacaccatgctgttgctgcccaacaccgtgatgcccagcgcctggtgccgggcgtgcgtctctgcgtaccacgtatgcatggccaccgagtcgaaagtggggatcagggtcacctgcaggtcacggtcccaatgctgcttgctggccagtagcgcgtccaggacggcccgcatgccttcctccttgcgctggtcctggccactgatgacgtagcagaggcgcgcacgtcggaagaactcctcatccaccaggtgggcgctgctcccgctgtgcagggtaggccaggtccaggtagaccggggacttgggtggggtggctgacacacgngg

SEQ ID NO: 6435 - DNA, 351 bp, Homo sapiens
  misc_feature 333: n = A,T,C or G
gagaagacgacagaagggagttagtggatataattaagggtctcaattagttgactttaggctgggtttatcctgcttggactgtcctaatcaggtgagaccttgaaaggactgggttcttcctgagcatagagactcacagtgtgagagggactcagcatgaggggtttcctccagcatgggctttgaaaatgaaagggctgtgggccgggtgcggtgcctcacgcctgtaatcccagcactttgggaggctgaggcgggcggatcatgaggtcaggagatcgagaccatcctggctaacatggtgaaaccctgtctctactaagaatacanaaaaaaaaaaaaaaaaaa

SEQ ID NO: 6436 - DNA, 418 bp, Homo sapiens
aatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatc

SEQ ID NO: 6437 - DNA, 53 bp, Homo sapiens
cgcttacttgatgaagcacactcggatgaccatgactgatgcttataaatttg

SEQ ID NO: 6438 - DNA, 532 bp, Homo sapiens
tcggcacgaggggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttc

SEQ ID NO: 6439 - DNA, 355 bp, Homo sapiens
tatacggctgcgagaagacgacagaagggcaacagtacaggaagttgggtagatgtggggacaacagagagactgtggcagaggcaggactgcagatctatggaaattgcctggaagagtcagctgtaagggatgagaatcctgagggtaaaagagaaaagggaaagactcctctttgatcttatgaagctgaaataacaagatcttaaacatgagtgagaatctgttgccccaacctaaggtgactttaaatccaaggtaaaaaacacggcatgggtattagtttgaatagggaaaatgagaactctctttgagcgcaaaaaaaaaaaaaaaaaaaaaaaaaaagtcgtatcga

SEQ ID NO: 6440 - DNA, 545 bp, Homo sapiens
tcggcacgagggcggattgcctggtcttgaactcctgacctcagttgatccgcctgcctcggcctcccaaagtacagggattacaggcatgagtcaccacacctggcctggtcatttacatttttgccagaatgaaagataagcaaaagttacacatgcacacatatacatacatgcgtgtgtagagattataggtatatgtgtatgggcatgtatgtatataccatttgtattgtcctccattttaactccttattttgcccatatttttgttgtctctcctaagttattttttggagacgggatcttgctctgtcacacaggctggtatacatgggtgagatcatagctcactgtagccttgaactcctgggctcaaaagatcctcccatcttagtttctctcaagtagctaggactgcaggcacacagcatctcaagatcctggcctcaggtgaatcgcttgacccaggagtggaggttgcagtgagccgagatcgcatcactgctctccagcttgggcgacaggaactgactccatctcag

SEQ ID NO: 6441 - DNA, 477 bp, Homo sapiens
ttcggcacgagggttttttttatatagtgttaggtaggtatctagttttactctttttgcatgtgaatatctgcttgtcccccatcattgttgaaaaaaactattctttccccattaaatgatcttgggacccttgtaaaaaaatcaattgactatagatgtatggggtccagaggattttaatggccagaataaattaggatatgtttgagatgattaaatgcagggtttctcaacagtggtactgttgataattctttgttttagggtccatcttgtgcattataagatgtttggcagcatgtctggcctttatttattagatgccagtagcacctcacctccatcttagtcataacaaacaacaatgtctccagacattgccaaatgtcccctggagggaggggagcacaattactcccagctgaaaatcattggtgagccagtgggtttgtgtgatcctcttgggagtttaaa

SEQ ID NO: 6442 - DNA, 568 bp, Homo sapiens
  misc_feature 283: n = A,T,C or G
tcggcacgagccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctanagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcg

SEQ ID NO: 6443 - DNA, 466 bp, Homo sapiens
acagaagggggaggacccgccttctctctcggcgtttccgctgtcagggccctgcggtgtgactcgcgggctcagctggtccggccgtagcacctccgcgccgtcgccatgtcgcggtttttcaccaccggttcggacagcgagtctgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagc

SEQ ID NO: 6444 - DNA, 572 bp, Homo sapiens
ggagactttaacatcagaaaaaggatggacttgttgcagttgctgtagcattcaaagtcaaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacagctttaccacatttcttcatgggatattataggtattctaaagaaacccatattaatccatcagaaaattcaacatcaagtttatcaacctgtttaattaatcaaaccttac

SEQ ID NO: 6445 - DNA, 522 bp, Homo sapiens
acagaggggggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgat

SEQ ID NO: 6446 - DNA, 137 bp, Homo sapiens; identical to SEQ ID NO: 1794

SEQ ID NO: 6447 - DNA, 80 bp, Homo sapiens
cggcacgagcgccgcaatgcccgcgcgcccaggacgcctactcccgctgctggcccggccggcggacctgactgctctgc

SEQ ID NO: 6448 - DNA, 754 bp, Homo sapiens
  misc_feature 480, 663: n = A,T,C or G
agaatctgaacaggggcagctttattgcagccttgatttattttggagtaagaaaaaaaaagaatggggataaactggtatataagaggaacaggaaggaggggagagaacccaacacatgaggtctgcacacacagctgtcctggttgccctcggtgcagctccgagctccagttacaaggaattccaagttctcaggatcttgaagactctggaggccagtaatccctggatcacactgcttctaccagctcagaagagaagtcctgcctaaggtcatgaaataaacctgactgctgccaccagaccgaacagaggcaaagaacaccttgtcattgcgttcacacaagaattttagtctttgagcccttttgtgcatgaacacaccatccaagtgaccagtttccacagatcggatctctatggccttctctccccagcccattgtctgattggatcgaatatatgctactgatgtangcatctctccccactgtagaactacatccttggtgatccttccatatgtgtttacataaaccccctcatcttcatagcacaccagaagcctcattccatctgtatttgggacgatgatgattgcatggtgtttgatgctacactggatatgtgttggtagataaatgtcatagactgatcctngatccacatcaacagcatggaatccagcacaggattcatagatcactttcaacctctgggctggcttaacagcgagatccaccagaatggg

SEQ ID NO: 6449 - DNA, 273 bp, Homo sapiens
  misc_feature 62: n = A,T,C or G
tcggcacgagggcggcggcgcggcgaggctggggctcttgtttaccagcattaactccgctngagcggaaaaaaaaagggaaaaaacccgaggaggagcgagcgcacccggagggccccggcggcgccgccttcggagtattgtttccttcgcccttgtttttggagggggagcgaagactgagtttgagacttgtttcctttcatttcctttttttcttttcttttctttttttttttttggaaaaaggggaattttctcccaaaaaaaaag

SEQ ID NO: 6450 - DNA, 191 bp, Homo sapiens
ccatacaccttacgcgcctagtactccggggtcccacaaaaagttttcatggcgggccccccactgatgccttctttgcagaggccaaagtcagcgatcttgatgcggtcatcttttcccaatcataatgttttcaacttgttgccttgtgttccacgccccccaatgcaacaactcaagaatcagacaat

SEQ ID NO: 6451 - DNA, 64 bp, Homo sapiens
gctgagtgtaaagcctcctaccctggaaagattaccaacagcatgttctgtgtgggcttccttg

SEQ ID NO: 6452 - DNA, 600 bp, Homo sapiens
  misc_feature 567: n = A,T,C or G
gagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccggtgagggaatctgcactccccgctctcctgccccccagccccagcaccctctgcagccctcgcacttgtcagcatctgtcaactcatatccgggccccaaagcttctgcagggcagaagtcaaagactcttaaagatccttacatggaacacttctgttttataattagggaaactgaagcccaagggttataaataagtttgctccaaatgacacatctcacattacaaattgatgacggagtcagggcttgggtactgatcttaatcaatagattgaattctttcactggtattaactgagcacctaggggccaaacgctatggtaggcatttcacacatatgatttcatttactcttcacaaccaaccctgtggagcaggcactattattaacttcatttgacatatgangaaatggagctttacagagagataattacctga

SEQ ID NO: 6453 - DNA, 415 bp, Homo sapiens
  misc_feature 2, 4, 112, 237, 270, 370, 407: n = A,T,C or G
ananaacagtgtttattgatgatgagtccagggctcctgctgaagccctgggtggggaggggcacagagcgagatggggcgtaatggaatgcttgaaggctgctccgtgatntcggtcggagcttccagactaggcgagggcagggtgaggcctcgggcacacagccggcgcccagtcacccggcccagatggagggcggccggccctgcacaggcacttgccaaggtggctcacantcacgcacactcgtactgagactcaaggccgtntccacaactccaaccagtgcaaatgacttagtgcaaattaaattcagaagggacgggggaaacagagtcgtggaggctttgaatctctcagaaaaaaggnaagacaggaaagtttcagaaacaaagagacagaaggntgaaaaag

SEQ ID NO: 6454 - DNA, 352 bp, Homo sapiens
  misc_feature 327, 338, 345: n = A,T,C or G
tgaaaagcaatataaagtcttaaagaaacggctgcctgcaaccaggatgttcttatgagctttgaagatttttccgcttaccacaatgctgacatcacaaagaatacctttctttctctgttcatttagttgtcgcagaagttgatagcaataagagttctcatttggcctactattaaagtcacagtacccctcctctgatggtatttctgactcctggggcgttggcttcgtgggagtttgtgctcggtagagacgtggtgcctcaggaggagggttttcttgtagttgcgggtccctcgcgaaagttcattcatggccccactnggggaaaggtnccacggnttccccc

SEQ ID NO: 6455 - DNA, 523 bp, Homo sapiens
  misc_feature 380: n = A,T,C or G
cggaacgaggcggggatgctgcgagggggtctcctgccccagcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccangtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgct

SEQ ID NO: 6456 - DNA, 403 bp, Homo sapiens
  misc_feature 392: n = A,T,C or G
atcaggaatgtggaattgaaaatgttccccaagtcccctttccacagtgtttggccagccctaacggaggcgccgggacctggtgagccagggcctggtgagtaaacggccctgcctgccccagacagggagcatctggtggtggccacgctcctgcagcagaggggtggggggagggccaggggacatcatggggacttcctgggctttctgtaggaggccagtgctctggtcacatctgaggtcttcctgacaaggggacacagctgtgacacggtgagtatcctgggctgataggaaacccagctgggatggctgagcacactcacccccggcctttcagagtgggatcagcagaggggcatcaggcgaaaacgttctgttgccggtantggcgtcagag

SEQ ID NO: 6457 - DNA, 425 bp, Homo sapiens; identical to SEQ ID NO: 1800

SEQ ID NO: 6458 - DNA, 525 bp, Homo sapiens
  misc_feature 418, 444: n = A,T,C or G
attcggcacgaggatcctgaccacggcttcagccgcatgagtgagcggcaagtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcanggcccgaccctgccctcacggctgangagtggctggggggtcgggatgctgggcccctcctcatctccctcaaggatggctacgtacccccaaagagccgggagctg

SEQ ID NO: 6459 - DNA, 517 bp, Homo sapiens
  misc_feature 393: n = A,T,C or G
ttcggcacgaggccatgaacaaggtcttctggagagagatggtagagtgcttcaacaagatttcgagagacgctgactgtcgggcggtggtgatctctggtgcaggaaaaatgttcactgcaggtattgacctgatggacatggcttcagacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtangaacactgcagcgcctgcccaaggtcatcgggaaccagagcctggtcaacgagctggccttcaccgcccgcaagatgatggctgacgaagccctgggcagtgggctggtcagccgggtgttccc

SEQ ID NO: 6460 - DNA, 574 bp, Homo sapiens
  misc_feature 402: n = A,T,C or G
attcggcacgaggggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcancgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactc

SEQ ID NO: 6461 - DNA, 361 bp, Homo sapiens
  misc_feature 119, 283, 307, 337, 351, 357: n = A,T,C or G
aatttgggggaggatatattccaacttgggggaagggtgaaggcattttagctctgaagctcaatcatgacatttctagagagttctgcagtgcccccgcattggacaggacaggatgnaagagtgtgctggactggctggattccccagtgtcaagctggcagcgctcctgaggttcttgagtgtttatcaactcagcaggtcaaaagtctgcagacactgggtggagcagcagtaagccacaaaactaacagttgtcttccactggtgcagccctgccatntggcgtctctctcaagggaaagancttggggtagacgatggtaaacattaggcncactacaccgatgncaattncccc

SEQ ID NO: 6462 - DNA, 563 bp, Homo sapiens
  misc_feature 101, 116: n = A,T,C or G
ctctgtcggggggacaggaagcggatcgtgtgaggtttccgctggcgcccgcgtagactcacgctgactgcaggcagcggggggcatcgaggggtgcttanccccagggcactcanaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttgaagaaaaatgctaagggcagccctgcctgccctccccatcccccgctgtaaatatacactatttttgatagcacacatggggcccccatatctcttggccttg

SEQ ID NO: 6463 - DNA, 618 bp, Homo sapiens
ggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagaaagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctac

SEQ ID NO: 6464 - DNA, 483 bp, Homo sapiens
  misc_feature 1, 189: n = A,T,C or G
ngcagactgaactccttctggacctggtggctgaagccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcngtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcagggggtaccagagactgaaagacacggcacaaatcttcaatattcatctcccacatcactttcctggggaacttggaaggggtgaaagttcctcaaa

SEQ ID NO: 6465 - DNA, 497 bp, Homo sapiens
cggcacgaggctggtgccacgaggcgtcccacaggcatgggtgtccttcctatatcacatggccttcactgagactggtatatggattgcacctatcagagaccaatgacaggacctccctggaaatctctgagacctggcctgtgatccaattgctgccttgtcctcttcctgctatgtcatggcttatcttctttcacccattcattcattcattcattcattcattcagcagtattagtcaatgtctcttgtatgcctggcacctgctacatggtccccgagtttaccattagtggaaaagacatttaagaaattcaccaacggctctatgataggccatacacggtggacctgactagggtgtggcttccctgatgagctgaacttgcccagaagcccacagaatgggagctgagcacgtttgaaccactgaacctgctctggacctcgcctccttcccttcggtgcctcccagcatcctatcctctttaaag

SEQ ID NO: 6466 - DNA, 576 bp, Homo sapiens
catcgtctcctcttccaatcagccctgctgaggcaggggacctctgcccgaaacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggaacccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttctttcatgagacctttgttactcggtggttactgggtcctgtgcctgtccgttctggggcatgcagccctctatcatttttggctccg

SEQ ID NO: 6467 - DNA, 461 bp, Homo sapiens
tcggcacgaggaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttcttt

SEQ ID NO: 6468 - DNA, 489 bp, Homo sapiens
  misc_feature 305, 346, 374, 441, 449, 454, 461, 467: n = A,T,C or G
acaatgtctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctcctcccagggaagctcctcacaagaagcctggccctgggaggcaagaaggactaaggcagcatctgtcccctctgtgattcagagcccttagttgagagcccctgccgcccctgccacccccctgccccgttcccaccatttgcccntcctcagctgttgcaagggaggaaagcattgtttagggaantttttcaggttccttgttgattaaaacntcctttaaatttgttttcaggaccaaggcaattgggagttttccttttcctgttcccatttttgggnagtttgtnttttnaaggggntggtangatgtttgggaaggcaggacaa

SEQ ID NO: 6469 - DNA, 464 bp, Homo sapiens
tcggcacgaggaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctc

SEQ ID NO: 6470 - DNA, 507 bp, Homo sapiens
  misc_feature 376: n = A,T,C or G
attcggcacgaggcccccttcccccagcccatccattaggccagcaacgcttgtagaactcactctgggctgtaacgtggcactggtaggttgggacaccagggaagaatatcaacgcctcactgaaacatggctgtgtttgcagcctgctctagtgggacagcccaaagcctggctgcccatcatgtggccccacccaatcaagggaagaacgaggaatgctggactggaggcccctggagccatatggcaagagggtgacagcttcctttcctgtgtgtactctgtccagttcctttagaaaaaatggatgcccagaagactcccaaccctggcttggggtcaagaaacagccagcaagagttaggggccttanggcactgggctgttgttccattgaagccgactctggccctggcccttacttgcttctctagctctctaggcctctccagtttgcacctgtccccaccctccactcagctgtcctgcacaaacactccaccc

SEQ ID NO: 6471 - DNA, 500 bp, Homo sapiens
ttcggcacgaggccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctc

SEQ ID NO: 6472 - DNA, 454 bp, Homo sapiens
ggctccatcagcctcggtgacagtgtggagatccctgccctcaaggtggtgtagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactccttcaacttctctcaagaataccttttccaggagcagtacctgtccaaggatttgacaccagcagtgacagacaatgatgaggccgacaagaaggccg

SEQ ID NO: 6473 - DNA, 421 bp, Homo sapiens
gcgtccgcccctggtcgtgcgcaaggtgcccccggctactccatcaaggtgttcgacttcgagcgctcgggcctgcagcacgcgcccgagcccgacgccgccgacggccctacgaccccaacagcgtccgcatcagcttcgcaagggtgggggccctgctactcccggcagttcatcacctcctgcccctgctggctggagatcctcctcaacaaccccagatagtggcggccccggcgggaggggcgggtgggaggccgcggccaccgccacctgccggcctcgagaggggcgatgcccagagacacagcccccacggacaaaaccccccagatatcatctacctagatttaatataaagttttatatattatatggaaatatatattatacttgtaattatggagtcatttttacaatg

SEQ ID NO: 6474 - DNA, 477 bp, Homo sapiens
taaacaggttgaatgatatatttatcaaatctgacagacatcacgcaaattatagcctggtgacaaaagtgttcatagtgaattaattactcttgtaatactacctataattagtacatcaggaatttcatccacttcactgatataactgaaaagactgttctctgcaacttcagctaattcatcatcttcactaacttctaaaaaataagcatcatcaatgccattatcccaaacagcatcaacagatgccccttttgacagcctgctatgtgatggtttatgaggattctgggtttcattgctcctacttgcatctgcttcatctgatggaaactcttcttcctttatttcagtggtgaagggataaacagtgggataggaaaatatttactcacgatatgcgatttaaccttatactctatgttgaagaaaggtatctaagtgacagatactaaagtgaatatgcaagatgaa

SEQ ID NO: 6475 - DNA, 655 bp, Homo sapiens
ttcggcacgaggaagctccgcacactctcggccggtcccgagtccgactccctcagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagaacagctgctcgccatcctgccc

SEQ ID NO: 6476 - DNA, 493 bp, Homo sapiens
tcggcacgaggtttttttttacaatgtcagaaaagtatttggctttttttttctttttaaaataagtgcatacaaatacagctagaagcatttctgatttgccaagtgctctaaaaaagcagcgcaagtcacagcctacatagaacggtaactgtcaccaggataataaagcacaaagatatgctaataacgttaacaaaagaaaaaaatgtctttataagtacataccttttgtcgtcaaaaaaaatatagaaacacaatgtattcaaaaaaaatcaaaattatacagccatgtttatgaagtctacatttcccttgtcttggatatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattgg

SEQ ID NO: 6477 - DNA, 403 bp, Homo sapiens
gaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggccacatc

SEQ ID NO: 6478 - DNA, 354 bp, Homo sapiens
gcgaccgccaactggacggcgggcttcggcgcgggcacacgccgcccggcgttgtgggcatccggcccgcgcggcgcggcgcgcgccgctcctcgtgctggaagaattcaagacggagaagaagctgtgcaagatgttctacgccgtcacgctgctcttcctgctcctctgggggccctacgtcgtggccagctacctgcaggtcctggtgcggcccggcgccgtcccccaggcctacctgacggcatccgtgtggctgaccttcgcgcaggccggcatcaaccccgtcgtgtgcttcctcttcaacagggagctgagggactgcttcagggcccagttcccctgctcccagag

SEQ ID NO: 6479 - DNA, 138 bp, Homo sapiens
taagcctgcaaaagcatgagcagaaatagtgctaatttggttgtggttgatgtagagttcttgaaggttgctgaggtcttgtagacagtaatcagtcatctcggtaatctgattttcatccaaatgcagcgttgtgag

SEQ ID NO: 6480 - DNA, 416 bp, Homo sapiens
caagccctttccagctcctccgatgaaggcagccccagccctggcatgggggggccactagatgcacctgggagccccctggcttgcactgaaccctcgaggacctgggcacggggtcggatggacacacagtcagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccacctctgcctcttgagtaccagacctcatgggaccagaccccttgggaccacatggcacaatgggacctctgttgta

SEQ ID NO: 6481 - DNA, 334 bp, Homo sapiens
tcggcacgaggttttttttttttttttttaacccttgccgccactttttttgggcactaacccttggaggttttacacaccccccccggggaatggaagggaatggggtttcattcggggcaggaaccttttggcggaagaacggggggttggtaataaaaccttggccccggggcccggccctttggcccccgaaaccttttggaaccctcgaatttaacctggcctaagggcgtgcaaattcgtaacctgaaccacccggggggaaactggttccccaatttttgggctcatttgggggctttaaagggcccggccccttgtttcatggggt

SEQ ID NO: 6482 - DNA, 527 bp, Homo sapiens
tcggcacgaggagcggagcagccgagcgagttagtgtcagccgagggccgaaaccggaaggcggtgctgtgccagcgttgcggctcccgggtgctgcagccagggaccgctctcttctctcgccgacagcttttccttccctccatgagaaagaagccagctctgtctgacggcagcaatcctgacggcgatctcctccaggaacactggctggttgaggacatgttcatttttgagaatgtgggcttcaccaaggacgtgggcaacatcaagtttctggtctgcgcagactgtgaaattggaccaattggctggcattgcctacatgacaagaacagtttctatgtggccttggaacgagtttcccatgagtaactgacgggaggggtactcagctccatctccaaagataaacctactccccacaagaactggcctttaatgtggtataactgttccgctgccttcttgtctgtgctaatataaatactgagtaccagcatgtccatttgaacatgcagagggtt

SEQ ID NO: 6483 - DNA, 575 bp, Homo sapiens
tcggcacgaggccaagagcaggagcaagaaaaacatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccct

SEQ ID NO: 6484 - DNA, 452 bp, Homo sapiens
tcggcacgaggattttttttttttttttttttcaaccccaattttttttattgaaaccggcccccgttggccctggttaaggcttttccttttcctttaggggaaccaacccattgggtaatttaagtgttaacccgttggttggcccatccctgccggatgtaataaagggggcagcaaaagcccaaaaggggctgggggccccaattttccataaaacctcccaccttttgccggaatttttccaagcccttccaaataattaattttttatctttaggaacccacggaaaaccttggttttccagaacaataaccgggggcacacaaggttgaggcaccattttttgattatccaacataataagtcctgcttcaggaaaaaattttgaatttcccccaaaatttttaaaggccagggccccagggttgtgtaaagggaaaatcaaagg

SEQ ID NO: 6485 - DNA, 605 bp, Homo sapiens
tcggcacgagggctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccaaaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataag

SEQ ID NO: 6486 - DNA, 596 bp, Homo sapiens
ttcggcacgaggaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttg

SEQ ID NO: 6487 - DNA, 506 bp, Homo sapiens
ttttctaaattaagggcttttaattttcagaccaaacatttttaatataaaaacattttgataatatacaaacagcaatcacaacagcatccacatggcagcaaggggaccagggcacagagagggggagcgggctggggagggacagttttcagggtcccagttgcttccctggcttgaaatcaccctggtcctagcagaggacaggttaagggctgccagaggcagagggtccctgaccctggcccggagacagactgcccaggcaggccctctgataccatcttccaaccatggcagcctccaggaaaagccagatccatttaggagataacaggaaggtggctgtgattgacaggaaaggcaacatggttcctcagcatcctgctgatcacacctctgggaggggctgctggattgaagaggacctaagaatcttcctgggagcaggacagaaatgggatctaagtctacctactaactaacattcccgcctgtgacaccag

SEQ ID NO: 6488 - DNA, 497 bp, Homo sapiens
tgaaaatcctatttataagagtgccgtaacaactgtggtcaatccgaatatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgct

SEQ ID NO: 6489 - DNA, 796 bp, Homo sapiens
  misc_feature 528, 782, 783: n = A,T,C or G
aatccaagtacaattttttaataaagataattacaaaagatggaaaaatcagctcagaaaggccaattacttctttaatagatcagtttttttgacataataactcacatcaattttaaatactatcacataaagcatggtggagaaaagaaattttgcttcataattagaaaaactcacaataaaacttgccaagaaaaacaaaaacgaaaaagccatttgaaaataaatacagtccatgccaaagtagtataaaatgaagccagaagtcttcaaaaagaaaacattttcctttcaatattttctttttaatgattttctgaaattggtgagactgtcaaattcaggggttgctgagctgttctgatttggttcctttggtatctgttttttcaccactgttgtccttggatttatcttcttccttaacgtctgtttttttggcctctgtttctttcttatcttcttcaattctagctttctttgctcctttcttatgatcagccacatttcttcgacctccttctncttcatcctcagaatctgagaattcttcatcacaagctatccgcttgtctgatgctcgaatagaaattctcttgtctggatcttctccatcttcatctccactgtcttcatgaacagcatcttctggaatagcttgcatctggacaccaggtgcatgaggtaacatgcgcaaattttcaaaacaacgctgttttatctttttcatatattcctgagtggtctggtttgtcatgtttgaaggactaatatgcagnntgaagttgggtcc

SEQ ID NO: 6490 - DNA, 569 bp, Homo sapiens
ttttaactaaaagataagatttaataacacagtaagacactcagttggggagggattaattgcaaaatatatcattatttcacagtgaggtttaagtactcataacaatcttctggttttagtagaacagatacccactggtgtatttttttcacatttgttttctataatttcttcccctctactatttcatataaagacactaatgtggtcaaacattaaactatcaattgacaatcaccttttgcttccctattaggaaataaccttcattgcttaactgcaactcaagagaattagggcacagtcaaccatgtcactgataaaaacataagaagtaatgcatcacatttattccaatctaaacacactgtcacagatgtggtaagtgaactggaacactggtgttccccagtgggtcatcagctacatatacatcacattcttttatcaaatctggcattgaaatttccttttccatatataggtttaaaaaaataaaattaaaaaagccacaggagcaaccctgacagagaagtcttgcatgcagccttctcctgagaaagtat

SEQ ID NO: 6491 - DNA, 553 bp, Homo sapiens
  misc_feature 390, 515: n = A,T,C or G
agttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggngcatataggtgggcacagtttgttttcttgtgaacctattaccttgaggatgtgccaagatttgccttataatactaccttcatgcctaatcttctgaatcattatgaccaacagacagcagctntgggcatggagccattccaccctatggtgaatctggat

SEQ ID NO: 6492 - DNA, 464 bp, Homo sapiens
  misc_feature 242, 255, 442: n = A,T,C or G
aaagtgacccagttttattttggttttggaggccagacagggcattgctccacgggttcgggctgtacaaccttcccctccttgaggtgggaggcccagcaaccacagggcccaggcagcggggtgggaggctcaggaaatggtggctctggggacccgatcccgaggagagagggggcagcaggcaaaggcctgcaatggctcaaattgggggaagagggcggcgagggggagaggacacnatccaagaaccanagtccgaaagctgaagctggtccggtctctttcactttacggccgaggctggggtcagagaagtgaagccaaactgtcctcccgcaggaggcaaggcctggagggacgccagggtcccagtccggtgccgggccctgcgcacacagccgccgcctccaccctcgcggagggcgcgcgcggggcccantcgctgggtgcagggtccggcg

SEQ ID NO: 6493 - DNA, 134 bp, Homo sapiens
ccagcctgtccccagcccctcaatctggtgccagcagcatcttgtcacctgcacaacagtggccctgggtcccccacaggcagttagggccccaggtcagccctcaccatgataggcccattggtcctggggtt

SEQ ID NO: 6494 - DNA, 504 bp, Homo sapiens
gccaagaattcggcacgaggggaatagtttccatggatatttttatttttattaacttttttcagtttctttttattcaaagaaacaaaattcaatctctgataatatttgaggtaaagttcctttccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagta

SEQ ID NO: 6495 - DNA, 578 bp, Homo sapiens
acagaggggcttcactttttccgttgctagcagtggaagggtcacagaccaaacactaaggcctgagcggtgacaatcgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggggagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttca

SEQ ID NO: 6496 - DNA, 618 bp, Homo sapiens; identical to SEQ ID NO: 1818

SEQ ID NO: 6497 - DNA, 498 bp, Homo sapiens
gcactactccagacagatggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgaggggcacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaagggcctcaagctcaacctcacggagacttctgaggcagaaattcaccagagcttccagcacctcctgcgcaccctcaatcagtccagcgatgagctgcagctgagtatgggaaatgccatgtttgtcaa

SEQ ID NO: 6498 - DNA, 119 bp, Homo sapiens
aaatcataagcatctacttcatgtggaccccactgtcataagggaactccactgcccacttacgaagaggccaagcaatatctgtattatgaaacgctatatgccaaaggcaaccgcac

SEQ ID NO: 6499 - DNA, 486 bp, Homo sapiens
gtcgacactagtggatccaaagaattcggcacgagatgatggttatgtagtctttaggaggatgcaattataacattgctcttcctttcacgcaccacatgatttagcaagtacttcatattggctccaccattaacatggtcaatggcttctggatactcacagttcaggcacagtttctcctgaagattttttacctctcccatctttaagaaattgtctggatgtccatgaaagatgctgacactttgtattaattcattaaaaaacacccaccccctcccttgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaaaagc

SEQ ID NO: 6500 - DNA, 563 bp, Homo sapiens
acagaaggggatagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagtccaacctaaggtgactgtatatccttcaaagacccagcccctgcagcaccacaacctcctggtctgctctgtgagtggtttctatccaggcagcattgaagtcaggtggttcctgaacg

SEQ ID NO: 6501 - DNA, 431 bp, Homo sapiens
ttgttgcctgctgtcccccaagaaaaccaaaatggtcgttactctctgacctatatctacactgggctgtccaagcatgttgaagacgtccccgcgtttcacgcctcttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacattgtggagtattacaacgacagtaacgggtctcacgtattgcagggaaggtttggttgtgagatcgagaataatagaagcagcggagcattctggaaatattactatgatggaaaggactacattgaattcaacaaagaaatcccagcctgggtccccttcg

SEQ ID NO: 6502 - DNA, 492 bp, Homo sapiens
tcggcacgagctctgggaggagagggtggagaaagccttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattccttt

SEQ ID NO: 6503 - DNA, 582 bp, Homo sapiens; identical to SEQ ID NO: 1822

SEQ ID NO: 6504 - DNA, 74 bp, Homo sapiens
taacgttgtctttcaaacaccctgagccttcctaaacagccagtgcatacattatgtctgggccacgaatgccc

SEQ ID NO: 6505 - DNA, 439 bp, Homo sapiens
ttcggcacgaggctgattccttctactctccaccccacaaattaacggggaccaatatttttaactttgcctattcgtttgtgggtgagtttcccccctccttattctgtcctgagaccacgggcaaagctcttcattttgacagacaagaaaaactgtttggaaccacaccaatgatatttttctttgtaatacttgaaatttattttttgtattattgggatagcagatgtgctatttatttatttaatatgtataaggagcctaaacaatataaagctgtagagattgggtttcattgataattggttggggagcctcctatgtgtgacttatgacttctctgtgctctgtgtatttggctgaattaatgacctgcgatataaagctatgctagctttcaaacaggatatgcctttcaaaaatgggtatattttgc

SEQ ID NO: 6506 - DNA, 408 bp, Homo sapiens
  misc_feature 357: n = A,T,C or G
ttcggcacgagggagccggcgaggagttccccgaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgcaagcttattccctttantgagggttaattttagcttggcactggccgtcgttttacaacgtcgtgact

SEQ ID NO: 6507 - DNA, 438 bp, Homo sapiens
  misc_feature 366: n = A,T,C or G
ttcggatccatgaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactanaaccaaggcccagctggcagtgctgatcgatcccacatcctgaataaagaataaagatctctcagaaaattc

SEQ ID NO: 6508 - DNA, 594 bp, Homo sapiens
ttcggcacgaggccagatgcctatacaaacacttcaggacaataagtcgatttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttaaactgtgacatggaatccatcattcggaatgacctcatggatggagatacattgga

SEQ ID NO: 6509 - DNA, 519 bp, Homo sapiens
catgatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctc

SEQ ID NO: 6510 - DNA, 672 bp, Homo sapiens
  misc_feature 574: n = A,T,C or G
ttcggcacgagggtggggagaggctgggtaggctgtggctgaccgtctggggtaccgtagagctgctggatgccacggagatcgtcctcgggcagcttgaaagttgtcaacgtccttccactggtagaacggcgccatgatggcattggggttgctggagtgctccagccccagcgcgtggcccagctcatgcactgccaccaggaagaggttgtttccatgcaggtcagtgctggagaaggtccagggctcatctgcgtcaaaatgggtgtccccgcctaggccggggccagggaaataggcgtgggccagaaagccaccggtgccatcaaacggcgagctgtcgccgtggaagccagaggcaaagagtaccatgatgtcggcctccttctgtcgccgcagccggatgtcctcatagggcacctcctggaagaccaggggcgtggcctgctcccacacgcggaaggccctgcgcaccgcctccatcgagtggtaccagcccaacttctccgtgtagttctggatgctaaaggtcagatggtggttgttccacttcctcccggtgagggcgtancgcttccgacgccgccgcaggttggctttcactcgtaccccgaactggtctggcaccccacagcggggccgcttcatccactccttggtctcttcgtc

SEQ ID NO: 6511 - DNA, 582 bp, Homo sapiens
ttcggcacgagcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcaaaacctggtggacttgccgatgttttctgtctacatgagcagtaac

SEQ ID NO: 6512 - DNA, 553 bp, Homo sapiens
ttcggcacgagggacgtccgcatcatccgtgacgacatgctgtgtgccgggaacagccagagggactcctgcaagggcgactctggagggcccctggtgtgcaaggtgaatggcacctggctacaggcgggcgtggtcagctgggacgagggctgtgcccagcccaaccggcctggcatctacacccgtgtcacctactacttggactggatccaccactatgtccccaaaaagccgtgagtcaggcctggggtgtccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatc

SEQ ID NO: 6513 - DNA, 635 bp, Homo sapiens; identical to SEQ ID NO: 1825

SEQ ID NO: 6514 - DNA, 621 bp, Homo sapiens
  misc_feature 353, 365, 573: n = A,T,C or G
ttcggcacgagggctatttaagtgatggacagcaggtgaccttgctttgtcagctggacctgaggtgctggtggaactctcagaaagggccggaggcccccccgacttgttttcaaatccaggggaggggccagtgggggaggagtaaccacttctgagcacctactatgggcgcagcacgtgtgggattgcttgcattcagcctcactggacccttgcgtccacccaggaggtggcaatgttacccccagtgttgagacccaaagggggacgtgacttgtccacagtcacagaaagtggggagctgggatttgaacccacctctacctggtctcagtccagggatcttctancccacctcccangctgtcttggagctccacctctaatccaaagggatgcagatgtttatttgacaaatatcagtgagcctccactatatgctgggcagtgggtagtgaccggggagtacttcgttttccttttcagtaaaaggcctaataatggcacctgcgtgatggaagtattgagcagaggagtgtggttcctcctggcctcacgggcactaaagangaaggcaaaatctatctcaccatcactaatgctatggtgcatttcttt

SEQ ID NO: 6515 - DNA, 524 bp, Homo sapiens
ttcggcacgaggacgacctgccgtttgatgggcctgggggcatcctggcccatgccttcttccccaagactcaccgagaaggggatgtccacttccgactatgatgagacctggactatcggggatgaccagggcacatacctgctgcacgtggcagcccatgaatttggccacgtgctggggctgcagcacacaacaacagccaaggccctgatgtccgccttctacacctttcgctacccactgagtctcaacccagatgactgcaggggcgttcaacacctatatggccagccctggcccactgtcacctccaggaccccaaccctgggcccccaggctgggatagacaccaatgagattgcaccgctggagccagacgccccgccagatgcctgtgatgcctcctttgacgcggtctccaccatccgacgcgagctctttttcttcaaagcgggctttgtgtggcgcctccgtgggggccagctgcagcccggctacccagcattggcctctcgccactg

SEQ ID NO: 6516 - DNA, 442 bp, Homo sapiens; identical to SEQ ID NO: 1827

SEQ ID NO: 6517 - DNA, 442 bp, Homo sapiens
  misc_feature 3, 5, 89, 347, 425: n = A,T,C or G
aanancgctgagagtcacttttattgggaaccatagttttagaaacacaaaaataattctttcacgggattggttccaggagcccagantatgagtggccccctactctccaaactgatcaatgaccttctgtatccacttcttcaggcggaacacatgtgtgtagaagccatatttcccatcccggtcacagccttcaccccatgagacgatgcccatttgataccagcggttgttaaaggggctcttcatgacaaagggtcccccactgtcaccttcacaggcatcccctcgtttcccttcatcaggcttgtaaccagcacagaacatgttgtcagtgatgcggntccgggtggagtccttgcagaccggccgttccacaatggggcaggttcaccacctgcaggacattggggttgcccttnaccaacgttggctgtcc

SEQ ID NO: 6518 - DNA, 671 bp, Homo sapiens
tcggcacgagggctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggccatcagaagaaatgaggtacgagctggatacccaagaggcatccacacccttagtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgct

SEQ ID NO: 6519 - DNA, 531 bp, Homo sapiens
cccccgtcggcttatcaggggggttctggacctggatcgccggtgagtggctggagaggctcgagatctagagcgtttccacggggctggtgatgtgcgtgagcgagaacgcttccgactggttgggggtgtccgagagcggcctcttcggcgtcgagaggaggtccgggaactttcctgccgggcaggtgaccttgagtgataaccagagcctcccctccgccgccgagtaacccgcgaccttgaccggctccgctgtcttcgccgagaggttgactgagaagatccagacctatctcgacgtcgggttgttcttgttttctctctccttgagcgggaacgggacctctggagtccacgaggctttggcgaaggagagcggcctctccttgaggttgtcttagtgcgtggagatgaagctgagcgccgtcggcgtgaagacctcgatttttcggctggctccggggaagacactgagggacttctccggtgcctttggggagttctagagcgagtttctggtgaggatga

SEQ ID NO: 6520 - DNA, 713 bp, Homo sapiens
  misc_feature 355: n = A,T,C or G
ttcggcacgagggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctancacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaagcctgcgccctgacatgctaacctctctgaactgcaacactggattgttcttttttaagactcaatcatgacttctttactaacactggctagctatattatcttatat

SEQ ID NO: 6521 - DNA, 425 bp, Homo sapiens
ttcggcacgaggacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaagtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctaccc

SEQ ID NO: 6522 - DNA, 453 bp, Homo sapiens
  misc_feature 12, 62, 186, 286, 401, 415, 445: n = A,T,C or G
ggtttcataagnaaattttattggtggtgaatacacaggggcaggcccaggacaagcagctnggctactccccctctgctggctgcccgaccggcagagggggctccatgtggcaggagctaggctcccaacgcccactgttcttgccaccctctgggctcccaggctgggctccgctaggctccngtctcccctgccagttaggcaagttcaggtgtggaggccgcagggatagatccaggtggctctgggctgggcctcttctcttcccagcggggaggtgctnttggcctggctgggctggcctgaatctgtttcaagttctcccttcctgcccagctcagttcaccagtgctggatccaggttcaaatgacagggacttggggtttttaaaacagcntggcaagtggtctntctcctggggcagccatatcccagacccantgggtttg

SEQ ID NO: 6523 - DNA, 564 bp, Homo sapiens
ccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcc

SEQ ID NO: 6524 - DNA, 484 bp, Homo sapiens
ttcggcacgagggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcaccc

SEQ ID NO: 6525 - DNA, 632 bp, Homo sapiens
ttcggcacgaggggcggcggcgcagagcttggggcttccttggtcgcacccaccacctgcctgcccactggtcagccttcagggaccctgagcaccgcctggtctctttcctgtggccagcccaaaactgaagcgctgcggcatggcgcgcgcctgcctccaggccgtcaagtacctcatgttcgccttcaacctgctcttctggttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggaaaacctgctggctgtgggcatctttgggctgtgcacggcgctggtgcaaatcctgggcctgaccttcgccatgaccatgtact

SEQ ID NO: 6526 - DNA, 219 bp, Homo sapiens
  misc_feature 100, 211, 215: n = A,T,C or G
gcgaccgcgcggtccagagccatcaccgccagaggacgcattcggccgaacccagagccagcgatgcgcacagtcgggccgtgcagtggctgcgcggcanagaagcgctggtccgcgcaggttggccagcagcggcggcaccacgctagtagtgaagcccgcgtctaccaaggccaggtggcagaggaagtagtacatgggcgtgtgcagncacnggtc

SEQ ID NO: 6527 - DNA, 606 bp, Homo sapiens
  misc_feature 428: n = A,T,C or G
cggcacgagggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagtttcgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccantctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggc

SEQ ID NO: 6528 - DNA, 705 bp, Homo sapiens
  misc_feature 668: n = A,T,C or G
gaatgagtgatgagagctttgttagcacccagcaaacaggccaatgggtgggttgacaggccaatggtggggtgtttgggcaggcagcaggggacaagtgggcaggtgaacatggctcaggcaggtaggcagagagtaagcagggaaaatgtatttgggggctgccctgtgaggggtgtggcatccctccagccgctgcctgctggggcctcggtctgtggcttaaaactcggtgtccaccacgcggaaagctggcctgcctgagtcaggcatcgacgaagaccgaaggctggcctccttttgtagctgaatctcctttagtgcaaatatggaagtagtgtcaggaagtttgtggatccgctcccccagactgaggaagaatggatgtttcatggcatcctctgcggagatccgatttcgaccctcaaactgcaacagcttggtgaggaggtcggccccgtcgctatcaagtctgggtgcgtggctcaaaagggcctcggctcggttcttggggtagttgtatgtcttgaactcctcgttggacaggatgcctggccacgtctcctcagttggggttccttagatacggaagatgaagtgtagctgttccttcaccgtggagctctggaaagaggggactggctggtgccatctcatataaaatgcantccacaccccacatgtcaattctgattggattagtcc

SEQ ID NO: 6529 - DNA, 544 bp, Homo sapiens
  misc_feature 459: n = A,T,C or G
ttgaatttcaaatgcagtttattgcagcaaaacaaggaaatggggagtttaagacctctccacaaaagaaaaacaacttgcttacaccttatgtacaaaaccaaaacagcacagagataagatgctaaggagctgtccacaccctgggtctaactggtcctactctggctggcttaaggaggtgctttgaaatgtcatgtgggtggtggtcactgctgaactgtttctcagggaaagaacaaagcagggtcatagccaggggactgagattgccactgatctgaaaacttcattgggaaacagcagaaaagaaagagctgggggaataggatgagctagtgtaactaaccataagctcttttctccggtaaggctgggacaaatcgacctcggtcttgccaagcatatttgttagtgatgctgggggagaactagagctaattgaaacagagggcatcnccttatctggttactcccggaataaagtggtagaaaccaacctcacgctggaactgccaccagaggacttgacaccccagagctt

SEQ ID NO: 6530 - DNA, 619 bp, Homo sapiens
  misc_feature 42: n = A,T,C or G
cttaaaactaaaaacttgagtctaccatttcttggttgcacntgaaaataccgcccagcctgatggtgttcccgtgctgtccctcccccttcccttctccccgcgtctacctccccaccccgttctgttccccctccctccttctccctctccctcaaatccgtgagttttggaagccccagggcctctctcccccgcccctcctggatgaggccaccatcccccaaaccggcttgttttgcagtttccccaggatcctggaagctcgctggcgctcgagggtggcggggacacgggggggtgggtgaaggttcgttaccttttctagtgcgttctatcatagttaacggttgcacacttttttaaaaaaagtaaatggatttgccacaattaaatgtcataacacttatgacagaatataaaatattaacatattttaagccaagttttaggtgtattttttgaatcttggttataaacccaattttaaagggcgatgtatccagcgttgtgaaggcaacagagtgtacccatatttatatttttataaaatacctataagactgtgaatctcttgtgctaatggctgagttaattgaaggatcgttttgcccctttt

SEQ ID NO: 6531 - DNA, 531 bp, Homo sapiens; identical to SEQ ID NO: 1834

SEQ ID NO: 6532 - DNA, 484 bp, Homo sapiens
  misc_feature 423: n = A,T,C or G
tcggcacgagtggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctancctgggagccaggatactggggtccttttcccactcttccactgacttgctgtgtgacctt

SEQ ID NO: 6533 - DNA, 653 bp, Homo sapiens
ttcggcacgagggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcatccggtgcacgatggcctgcggctgtacatccagaacctcggccgcgagctgcgccacacactcaaggacgtgccggccagctttgcccccgcctgcctctcccatgagatcatgatgcggagccactggacagatgtccacgtgaaggggacgtcgctgccccgagcactgcactgctgggacaggagcctccatgacagccacaaggccagcaagacccccctcaagggctgccccgtccacctggtggacaagctgcccctggccccactgcaacccctcatgcccca

SEQ ID NO: 6534 - DNA, 624 bp, Homo sapiens
  misc_feature 365: n = A,T,C or G
ttcggcacgagggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctanagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcat

SEQ ID NO: 6535 - DNA, 396 bp, Homo sapiens
  misc_feature 74: n = A,T,C or G
aatctgtcacccctcctagatcattatcccaggctaatcaaccctctctaaggcagtttccattcttgacttantgggagggaggaacaagcccctcggtgctggggagctctgggggaggtagggactgactgggcccaacccactttgttttggaaggtcaagcttagtaattaacctgaatgcttgggggagggggtgaaggagaaagaactgagtctaaggatgtgccatgtctttcaaattgctaattatcagcgagcatgatgtcatccgtaaatatatctaattctttagcttgtaattaaggtgctcattaaaagtgcagggaagacttgttttcctaaaaggggaaaaaaacaacaacacaaaaagtctttgttttgacctgacacg

SEQ ID NO: 6536 - DNA, 698 bp, Homo sapiens
  misc_feature 433, 668: n = A,T,C or G
cccggctgcagcatcctgtccaagtgctgccacgcgatggtgggctgatctaccccttcgcctggcagcacacctacatcccggtgctgccacccgccatggtcgacatcgtgtgctcgccgacgcccttcctcatcgggctgctctccagctcgctgccactgctcagggagtgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttnctgacgtcgggcgagcgtgaggagagaaccctgcagcgggaggccttccgcaaagctgtctcctccaagagcctccgccacttcctggaggtcttcatggagactcagatgtttcggggcttcatccaaggagcgggactgcgccggcagaatgcaaaaggtctgtttgaggtccgagcccaagagtatctggaaacactccccagtggagaagcacagggttgtcaataagttnctgaagggacttaggcaataaaattaaatt

SEQ ID NO: 6537 - DNA, 478 bp, Homo sapiens
attcggcacgaggaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccag

SEQ ID NO: 6538 - DNA, 525 bp, Homo sapiens; identical to SEQ ID NO: 1838

SEQ ID NO: 6539 - DNA, 490 bp, Homo sapiens
gtgattatacgttttattagactcgggaggggtatggcagggcttcatcagtgttccttcaaattaaaaaaaaaaatacaaaagctacgtagaaaacgtcagatcagacgactaaactttcccgactcagggccaagttcttcttgagcctgcgctctcgggacgcctgcgagtcggtctccgagtacgggggcggcgcgggcgggtagtaggcctcttcctcctcctgtttgtggggtctcctcctctcctccgaccccttcttcctcacagcctcctccagtagccgcccatcataggggaggtccccggacctggagccgttgtcccgagggtcccggttacggtggtggtgggacctggggtcggcaggagggcgctcccgagacctgaagtcgtcgtagtgggggtcccgggagcgtgggaagtccctcgagtcgtcttggtcatagaggtcgtcccggctgcggctcccggggggcatgtaggc

SEQ ID NO: 6540 - DNA, 584 bp, Homo sapiens
tcggcacgaggcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagcattatacccacacccacccaagaacagggtttgtt

SEQ ID NO: 6541 - DNA, 543 bp, Homo sapiens
ttcggcacgaggagtgcagtggcctggtcttggctcactgcaacctccacctcctgggttcaagggagtctcctgcctcagcctcccgagtagctgggattacaggtgtgagccaccatacccagactcatttgatgagttttgatgtaaaagcatgtaactcaaacccctatgtctggaacatctgtattacatctgaattttttcacctagtcaattcctgcacctctctctcctgtcccttcttccctcccctggcagtcagctactgttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaacgtttcacctgttaggtgaacaactaactggtgaacaatgggctgtttctagtttggggctatcatgaataaagttggtatgaacatgt

SEQ ID NO: 6542 - DNA, 337 bp, Homo sapiens
ttcggcacgaggctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgaaagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttg

SEQ ID NO: 6543 - DNA, 372 bp, Homo sapiens
gcggccgcccagagcaggtggggacgcgcaggcctcgaggtcgtcctcccgcgccaggcgacgcagccacaccagctcgcagttgcagtgcagggggttcccgccaaaggccagcaccagggcagaggcgggcgagccccggggcctggcgagcaggggcaggcgggagaagagtgggtcgggtgggattgtggtcaggcggttggaggtcatgtccagccgggccagcttgtgcaggcgggaaaaagcgccggcgggcacagaagccagcaggttgtggtcgaggcccaacgtgttgacgttgcccaggcggcccagggcctcccagggcagctgctcgaggttgttgtaggagaggtcgaggtcctccag

SEQ ID NO: 6544 - DNA, 568 bp, Homo sapiens; identical to SEQ ID NO: 1842
  misc_feature 431: n = A,T,C or G

SEQ ID NO: 6545 - DNA, 485 bp, Homo sapiens; identical to SEQ ID NO: 1843
  misc_feature 144, 443: n = A,T,C or G

SEQ ID NO: 6546 - DNA, 692 bp, Homo sapiens
  misc_feature 472, 485, 573: n = A,T,C or G
ttcggcacgaggggtgcctcctggcaggctctgaagagctggggctccgggaagacacgctgagggtcctagctgccttccttaggcgtggtgaggctgccgggtctcctgttccaactccacctaggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctanccatggagctganccggcgcgtggccgggctggggggcaccctggccggactcagcgtggagcacgtgcacagcttcacgccctggatccaggcccacggnggctgggagggcatcctggctgtttcacccgtggacttgaacttgccattggactgagctctttctcaaaagctgctacaagatgacacctcatgtccctgccctcttcgtgtgctttt

SEQ ID NO: 6547 - DNA, 418 bp, Homo sapiens
tcggcacgagggccttctgcaagaactgttgcaatgaacatttgcacatgttcaccatctggctgggctacatcaactccacactgaaccccctcatctaccccttgtgcaatgagaacttcaagaagacattcaagaaaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaagcaccatagaagaacagcagatggcggtgatcagcagagagattgaactttgaggaggaagcagaatctttgcaagaaagtcagacctgtttcttgtaactgggttc

SEQ ID NO: 6548 - DNA, 503 bp, Homo sapiens
gccaaggtcgtcactgatctcaagatttcaaccttgaccatgggcagtgaccatattgaaaggggagcaagttcggcagtgggagagttgaccgtgtcaccccctgcattgtgctgccatttggccagcctgtccaagggcatgacaccaagtatacactacagacagagaaacactacagcaacccagggttgtcctgaaacagacttttatacttgaacatggagactgcacatggactttacggtttgtgctgtgggataaacggaagctacagtgagaacatagccagtcccaaagacaatttcaaagaaaaatgacagtaaagattatctgggagtagtctttgacagtgcttatttgatactgtctctcagagtttgcaaaccagattgtacaagtcattaacgtcagatagctttaaagttgcgaccttcttgtacatgaatcttctagccagtttcctttcctttgtaacgaaacatgaaatcatagaatgtatg

SEQ ID NO: 6549 - DNA, 570 bp, Homo sapiens
  misc_feature 480: n = A,T,C or G
ttcggcacgaggcggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaagctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctancagcccagcttgtccccgcgcccgtccccgccgcggcgctccgaccccggcccccggtctacgacgacggccccgcgggcccggatgctg

SEQ ID NO: 6550 - DNA, 361 bp, Homo sapiens
tgtcccctgcaaaatggacaaagcttaccccttggctgtgcagggtcaactttctgactggtgatagggattctcatgcaggttaagcttgtgctgctcctcctcacctgcaaagcttttctgccacttttgcctccttggaaaactcttatccatctctcaaaactccagctaccacatccttgcagccttccctcatatacccccactactactgtaaccctgtccttccctccagccccactctggccctggggctggggaagtgtctgcgtccacctgtctcccctgacctcaaggttccttgggggctgctctgaggcctcagtacagatggggctctggaaatgtttgttgactg

SEQ ID NO: 6551 - DNA, 259 bp, Homo sapiens
tggtacgcctgcaggtaccggtccggaattcccgggtcgacatcatcatcatgatcgctcgacatcgatacgactttttttttttttttttttgttttttaaaaaaaaacggggtttccccttgtaacccaggagggtctaaatttcttaacctaataatccccccccttaaccctccaaaagggttggaataacaggcgtaaggaaccgaccccggccaaaagccttttttttttaaaaccccttgctggagaaaacc

SEQ ID NO: 6552 - DNA, 609 bp, Homo sapiens; identical to SEQ ID NO: 1847

SEQ ID NO: 6553 - DNA, 332 bp, Homo sapiens
  misc_feature 192, 239, 290, 314: n = A,T,C or G
gttgctggatccgctgccgctcagtctctggggtgaactcgaagctcagtggccgtatctcatctctccgcaccaagatggccctgctatccccagcattggccatgtacagctttccctgcagggacacagccaccagggctgtgcagccgcccatctggcctgaggctccagctcccgcccgatcacctnatcacattcctgaaaggcactctccaatgccccgatcaccatgtctnctgccctgatgcccttttcctccacaaactgagggtcactggggcagatgnagcggccattgaggtgcatggggnagctgagtggccaccaag

SEQ ID NO: 6554 - DNA, 209 bp, Homo sapiens
ggtcgacccccactgcactctgcctgggcaatagagcgagaaaaaaattttttttaaattaggttttcataattatctttttcatcattatgaaagcaatccttccacaccaagggaaacattgagaaaataccaagttttagaaaggcgaaatgaaaataaatctcctaacttcccatcaaaaaaaaaaaaaaaaaaaaaagtcgacg

SEQ ID NO: 6555 - DNA, 496 bp, Homo sapiens
tctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgt

SEQ ID NO: 6556 - DNA, 550 bp, Homo sapiens
acagagggggagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatg

SEQ ID NO: 6557 - DNA, 559 bp, Homo sapiens
acagagggggcagagcttttgaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagc

SEQ ID NO: 6558 - DNA, 470 bp, Homo sapiens
agtggatccaaagaattcggcacgagatgatggttatgtagtctttaggaggatgcaattataacattgctcttcctttcacgcaccacatgatttagcaagtacttcatattggctccaccattaacatggtcaatggcttctggatacctcacagttcaggcacagtttctcctgaagattttttacctctcccatctttaagaaattgtctggatgtccatgaaagatgctgacacttgtattaattcattaaaaaacaccaccccctccctgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggcta

SEQ ID NO: 6559 - DNA, 551 bp, Homo sapiens
tcggcacgaggccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttg

SEQ ID NO: 6560 - DNA, 215 bp, Homo sapiens; identical to SEQ ID NO: 306

SEQ ID NO: 6561 - DNA, 539 bp, Homo sapiens
tcggcacgaggcacctgccgtaggcacatggaggaggagcccagagttgggcactggcaaatgtctcctccctcccatgctccttggcttctgaaggctgaagctcctttggctgggccaagaaggatctagtctgcccactacattctcaaacaagaggacttggaggaaaagagctgctatacatcatatgcagaggaagcttctacgcgctagagaggatcaaggggccacactggaccatgtgaacagccatcctgaactgccatcagctaccacactggactctgcagggcagccatcctggatgatggaagccaccatattgacttggggtataggcccaaactgccttcgtttggtccagggccatcgtgggtgatgacgattgctctcttgcactcaaggacatttgatgctggtagtatggattatgagatggactagcccctgccccagcccagctctcacattcccctttgttttttcccataccaactgcttctaccctcccctattacatacatctttcaatgtcc

SEQ ID NO: 6562 - DNA, 563 bp, Homo sapiens
ttcggcacgaggctgtatagagacaaccatttagatgacaatcacaagacttacagtctataaggcaggttttatttctggttcttctgtgaacctatttgggtaacccccgccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatct

SEQ ID NO: 6563 - DNA, 551 bp, Homo sapiens
actaagacttgagcttttaaatgtctaacaatatcctgtaatcctttatgaacttcaggccttaagggatattgcgtttgatagggaaaagtggtggggtcttttagcctgatttggattgggcgggcatttttgccattctgcattgtccttccaatgcccagacttcagtgttgattccctccttaagcaggggacaacaaaagggtaacttgttccccatattcacgtagataatagctccagctttggctaatatgtccctccctaataaggatatgggactttcaggcataacaagaaaggcatgtgaaaagagcaaagtctcccaattacaattaaggaggtgggagaaatacctggttacatgctgtcccaggattcctcagatggtaatggactttgaggacagccgaccagggcaggagattaacactgagagggccgcaccagtatccaagaggaagtcaatttcctgtccctcaatagttaaatgtacctggggctcagtgagggtgatgacataagccggtgcttgttccaggcaccct

SEQ ID NO: 6564 - DNA, 435 bp, Homo sapiens
cggcacgatgagtgggagcggcgtcggagggccccctcaaggcatcctgggctacactgagcaccaggtggtctcctctgacttcaacagcgacacccactcctccacctttgacgctggggctggcattgccctcaacgaccactttgacaagctcatttcctggtatgacaacgaatttggctacagcaacagggtggtggacctcatggcccacatggcctccaaggagtaagacccctggaccaccagccccagcaagagcacaagaggaagacagagaccctcactgctggggagtccctgccacactcagtcccccaccacactgaatctcccctcctcacagttgccatgtaaaccccttgaagaggggaggggcctagggagccgcaccttgtcatgtaccatcaataaagtaccctgtgctcaacc

SEQ ID NO: 6565 - DNA, 627 bp, Homo sapiens
  misc_feature 90: n = A,T,C or G
tcggcacgagctggaccctcatgcaccctggacgactcacgcattaccatgaggggctccccaccaccaggggcacccgctacatcgcantctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcaaactccaagggctgccctgagtctgggacttctgcctccatggctggtcatg

SEQ ID NO: 6566 - DNA, 522 bp, Homo sapiens
cgcgtcgactgcccagagtccgcggccggggcgcggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctg

SEQ ID NO: 6567 - DNA, 228 bp, Homo sapiens
gcatcattagggctgatctccctgctggtatcggggcaggcggcgggggtcctgacatccgagggccggcggggaccacgaagcacttggggaagatgccgatgcgccgtcacagtggccctccagccatgcctggtccacttcacacaggacgtccaccgtgtccccctgtcggaagcccaggtcctctggcccctggcgggagtagctgtgctgggccaccacctg

SEQ ID NO: 6568 - DNA, 595 bp, Homo sapiens
tggatcccccgggctgcaggaattcggcacgagggcagcaagatggtgttgcagacccaggtcttcatttctctgttgctctggatctctggtgcctacggggacatcgtgatgacccagtctccaaactccctggctgtgtctctgggcgagagggccaccatcaactgcaagtcgagccagagtgttttatacagctccaacagtaagaactacttagcttggtaccagcagaaaccaggacagcctcctaagttgctcacttactgggcatctacccgggaatccggggtccctgaccgattcagtggcagcgggtctgggacagatttcactctcaccatcagcagcctgcaggctgaagatgtggcggtttattactgtcaccaatattatagtactcctcacacttttggccaggggaccaagctagagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaact

SEQ ID NO: 6569 - DNA, 378 bp, Homo sapiens
ttcggcacgaggttttttttttttttggcccacttaattttttttttttttgaaaaaagggagtcgccctacggggccaatgctgatttaaaactccggaaatcaaaggatcctcccacctgggcctccctttttgaatatagagggggctaaataaaaaccacccaaatgcaggaggggataatttttttgctgggaattttgtggttgggggaaccttaactttaaggcccgggccccttaggcaagaaccttgtaaatccaggccgaatatttcgccacgggggggaaaatccggggttttttggggttgccgaaaacccccaaccccaagggaaccaccccttaaaccacccccccgaacacaagggggccccg

SEQ ID NO: 6570 - DNA, 628 bp, Homo sapiens
tcggcacgagccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaatt

SEQ ID NO: 6571 - DNA, 552 bp, Homo sapiens; identical to SEQ ID NO: 1861

SEQ ID NO: 6572 - DNA, 372 bp, Homo sapiens
  misc_feature 176, 257: n = A,T,C or G
gagcttcagtcccactccaggcttcacccccaccctgggcttcagtcccgtgcccagttccaccttcacctccagctccacctatacccccggtgactgtcccaactttgcggctccccgaggagaggtggcaccaccctatcagggggctgacccatccttgcgacagccttcgnctccgaccccatccccaacccccttcagaagtgggaggacagcgcccacaagccacagagcctagacactgatgaccccgngacgttgtacgccgtggtggagaacgtgcccccgttgcgctggaaggaattcgtgcggcgcttagggttgagcgaccacgagatcgatcggttgggagttgcagaacgggagttg

SEQ ID NO: 6573 - DNA, 467 bp, Homo sapiens
  misc_feature 406, 435, 449, 455, 463: n = A,T,C or G
gggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtaactagtggctagctggcgtgaagctggctcctctgggtcccaacggtccctcccctccctgcagggacccaggcatgagggcttctccaggcccattcccagaagtcccagaagtcctccctgagggctcagatcccagggtggtcagcagggcagacaggaaagccaccatgggtctattttctctttctctgcatcctcccctgattcgtccttnctgtccatggttcgggttgtaatgttcancctctggcttttgntgtcantgttctgntatt

SEQ ID NO: 6574 - DNA, 392 bp, Homo sapiens
  misc_feature 168, 293, 299, 322, 340, 385: n = A,T,C or G
atttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgngggtggtggcactgagagcctgggggaacaggcgccaggccagtggccagggacggcacggacggaggcaataaatactgatggccagggcggggctcctggctgggcccagggtggggtgggtnaggctntccatcgagggctcttggggggntttgggctctgggcactnccccttgagacagaaaaggcagaggcaggacaattacccagcctnctgggat

SEQ ID NO: 6575 - DNA, 605 bp, Homo sapiens; identical to SEQ ID NO: 1862
  misc_feature 325, 474, 545: n = A,T,C or G

SEQ ID NO: 6576 - DNA, 516 bp, Homo sapiens
tcggcacgagacaaaagcacaattgctagattggatggtaacaggttgtttagctttgtaagaaattgcaaaactgccttccaaaatggctgtcctattttgcattcccaccaacaatgaaggagagatcccattgctccatatccttaccagcatgtggtggtgtcagtgttctggattttagccattctaataggcaaataatggtatctccttgtttttttgtttcttgttttgttttgagacagtctccctctgtagctcaagctggagtgcaatggcacgatctcggcccactgcacccggcccaaaatgtttttaaaaggcatcacaggaaatgtaacacaaacagcttaatatttggttttatggaggtgatttaaggagcaataggaagtaatttattgataataaaaaagccgttaattttataattgtaaagaatgttaaggaatttgtggtcttcctgagtaaattacatctacttaattaagcggccgcaagcttattcccttt

SEQ ID NO: 6577 - DNA, 397 bp, Homo sapiens
acatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatgga

SEQ ID NO: 6578 - DNA, 570 bp, Homo sapiens
tcggcacgagggacgcctacccgccgcagtactgatcattctatttccccctctttgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgccttactcatttacaccaaccacccaactatctataaacctagccatggccatccccttatgagcgggcgcactggttataggctttcgctctaaaattaaaaatgccctatcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatc

SEQ ID NO: 6579 - DNA, 549 bp, Homo sapiens
agactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcctgagttccagcgctgcagccatttcttccagatgaagaacatctccttctgcggctgccatccccgcaacagctgctatttcggcttcatcaccaaacaccccctgctgagccgcttcgcctgccacgtctttgtctccc

SEQ ID NO: 6580 - DNA, 556 bp, Homo sapiens
  misc_feature 433: n = A,T,C or G
tgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtangccagaggtcgatggagtccgcaaagccctgcaagacctggggctccgaattgtggaaataggagacgagaacgcgacgctggatggcactgacgttctcttcaccggccgggagtttttcgt

SEQ ID NO: 6581 - DNA, 488 bp, Homo sapiens
  misc_feature 324, 404, 448, 465, 475: n = A,T,C or G
aaattcatgtttttaattggacttaatacaaaggtcccccaggaggccctgggaggagggggacagcctgggagaggcagagattcatggccagcagcccacccccacctgccacccactccccaacaagggtcccagactctttcaataatcctaaaaaaaccgacgagagcgcaggcagatgaagagccccttcatcttcacacgggtgacaggctgccctgccctgcccagggccctggttcctccccagccaagtcaggtgcccagcccagaccctgccctggcaaggtggggcagagcaatctggtcctccagggaggncagggcgccatgttaaacattcaacagggccagaccccatttccttccagccagtgggggccccggagttccagttgttncaccccacagcttgtttcagttcagttcaatttccagggcattncttggtttcggttgganggttgacagnttgggggcaggtt

SEQ ID NO: 6582 - DNA, 440 bp, Homo sapiens
ctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgtttagtgacaagagggacatctcgcgatttctcgagtccaaccctgtgatgattgatgccaaaga

SEQ ID NO: 6583 - DNA, 605 bp, Homo sapiens
  misc_feature 385: n = A,T,C or G
tttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcangccccgaggtcagggtttgagggatgagaccaggtgatagtgggggaggggttacttcctttgttacctaacaagtagggctatttccatcggtattttaaatgtggggtcacagatcttttggggagggtgtgcttggcagggggcctcttggagccaaaggatgtggtgtgagttgcgattggctggcactcacacccccacccctcacccacatccc

SEQ ID NO: 6584 - DNA, 560 bp, Homo sapiens
cttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctga

SEQ ID NO: 6585 - DNA, 606 bp, Homo sapiens
  misc_feature 333: n = A,T,C or G
ctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcangaaaaggatggaccttctcttcttctcagatggtcccttccattcccctgaaacctgcatgagagctcctaacatgtttctccaatgcaatcaagccctaaactccaaatgtcctcccagctcacccccatctatgcatctcatctctggatttggtgatcagactctatattgacagtaggatctcaaaccctgcatccatccttcctccagcaagccctgctagccacatgaagaacaagtttccgtgtcttctgccttcctcttggggaa

SEQ ID NO: 6586 - DNA, 376 bp, Homo sapiens
tcggcacgaggccgcactttttttttttttttttgaaaagggaatctccctccgccccccaggttaaagggcaggggggcaatttgggttaattaaaacctttgcctccggggcccaccccttttttttgcctaaccctcccaagaagtgggaaccaaaggcgcttgccaccaccccgggttaatttttggattggtaaaaaaaaacagggccccaccttgtaacccaggagggtctaaatcccccaaccttggaacccccccccctaaccctccaaaagggctaaaataacagggggaacccaccgccccgggccaaatgtcccttttttataaggacaatttgttattgggagaaacctgcccaaacccccccc

SEQ ID NO: 6587 - DNA, 605 bp, Homo sapiens
  misc_feature 405: n = A,T,C or G
tcggcacgagggtttccgcctctcccgcatggtcccgagatgctggggacagcactccgaggctaatggctccagctcactaggccgatcctgctgtgcccccgagctgctccctttcctgcacctcccaggaccgcccctccctgaactgctttccctgagccccttattcccgctcactccctcttggaggaccttggcctgttcatttgcagagaagatagaaatggccacacttatgaccccttagctcccccactcctccctacaggcccacccctgaggacacccaggccaccctgcctcctcccgtccgccccaaagggaccagacacaggtccctgagccttggggagtccacaggctccccatcttctccttactgcatcccagcccacatctcancccttccccatggcaggggctccccgcagacgatgccaccttccttgtccccgcagctgcttgtggcggattcctcaccaagctcaacggctccatcaccagcccgggctggcccaaggagtacccccccaacaagaactgcatctggcagctggtggcccccacccagtaccgcatctccctgcagtttgacttctttg

SEQ ID NO: 6588 - DNA, 535 bp, Homo sapiens; identical to SEQ ID NO: 1870
  misc_feature 211: n = A,T,C or G

SEQ ID NO: 6589 - DNA, 625 bp, Homo sapiens
  misc_feature 391, 399: n = A,T,C or G
tcggcacgaggctaggcccctgtcagagacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagaaaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccanaaacctancctggagttcaaggagtttgtagggttgccctgcaagaatcggccgccttttcccaggaccggagctaccaggggagcccaggagccctgctctgtctgggaacccccaaagagtcatcgtgatggttctgccttccagtatgagtatgagccaccctgcacgtccctctgtgctcgggtccaagctgtcaggcttcctccccagctcatggcctgggccttgcac

SEQ ID NO: 6590 - DNA, 377 bp, Homo sapiens
  misc_feature 1, 344, 372: n = A,T,C or G
ngaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggacccnccatgttcacggcagctttcacagacgnggctc

SEQ ID NO: 6591 - DNA, 195 bp, Homo sapiens
taaaaccaaaaagggtttcttctaaaacccagggaaaaggggtccttttataaaggcaactttttgtttttttgccctggttgctgcccccacccggggaaccttgaaacatggtccctaaaaggcagccataaaggtttttcccccaccctcttttgaacggaaggttcattgccaggccaccctccaaaaggg

SEQ ID NO: 6592 - DNA, 658 bp, Homo sapiens
  misc_feature 550: n = A,T,C or G
tcggcacgaggatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgangaacgttccagattactcttggtggaaggctctatagctgagaagtggaaggatcgactcggtaaaaaagttaagcgctgggatatgaagcttcgtcatcttggactc

SEQ ID NO: 6593 - DNA, 663 bp, Homo sapiens
tcggcacgaggaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgc

SEQ ID NO: 6594 - DNA, 403 bp, Homo sapiens
ggcgcataacgtcattgaaaggcacccttaggtggggagacgaggttcctgaggcgcagcggccagggggtcatccccgggcagacggtgcccctccaagctgacggcaccccactccaccccccccgcggaacctgccttcaaggctcagctccgcacacaaagaatctggagctgccgaggccactccctaccactcacccatcaatcctcccacgctcccggtcaccaacacgcgtcccgaaccgcgcctcttcatgtctggcaggaaggcctgcagcatccgcacagtccctactacattcacgtccagcacagaggccacggcgtcctcccccagcgcctccagcggccccagcaggcccaggccgcaagcttattccctttagtgagggttaatttt

SEQ ID NO: 6595 - DNA, 509 bp, Homo sapiens
tcggcacgagggggaggcggcggcggcggcggcgcgcgctgcgggcagtgagtgtggaggcgcggacgcgcggtggagctggaactgctgcagctgctgccgccgccggaggaaccttgatccccgtgctccggacaccccgggcctcgccatggctgaccatctgactgaggaccacattgcagaggtcaaggaggccttctccctctttgacaaggatggagatggcactatcaccaccaatgaggtggggacagtgatgagatccctgggacagaaccccactgaagcagacctgcaggatatgatcaatgatgtggatgcatatgggaacgggaccattgacttcccggagttgctgaccatgatggccagaaagatgaacgacacagacagtgaggaggacatccgacaggcgttccgtgtctttgacaaggatgggaatggctacatcagcgccgcagatctgcgtcacgtaatgacgaacctgggggacaatctgaccgatg

SEQ ID NO: 6596 - DNA, 579 bp, Homo sapiens; identical to SEQ ID NO: 1874

SEQ ID NO: 6597 - DNA, 388 bp, Homo sapiens
  misc_feature 336, 364, 382: n = A,T,C or G
gtccgttccaggagcacacggccctgcccatcctgggccttacctcccctgccagggctcgggcgctgtggctcctgcttgatgaagcccgtgtcctgccttgatgaagcctgtgccacctgcaagtgcccgccctgcccctgccccaacccccaccgaagagccctgagctcaggctgagccagccacctcccaaggactttccagtgaggaaatggcaacacgtggaggtgaagtccctgttctcagctccgtcatctgcggggcttctgggtggctcctgcacttgacctcaccggcatgctggcctgtggacggcctaaggaccttagggcnggggaggagggagctgccggaaaggccntggttcccagcaagaaanaaggga

SEQ ID NO: 6598 - DNA, 510 bp, Homo sapiens
tcggcacgaggcattttttttttttttttttttggcaaaaaccacaaaattttatttaaaaatcacagggtttaaccggaaatgccccgtccttagggggcccccttgaaaataaaaatttcttaaaaaggcccttccaaccccaaaaaaaggggggaaccagggcccatttgggggtttggaaggcttttggcccttccaattaattttggaaaggaggcccatttttaaggggttacttggaacaggttttgttgccggccttgtttttaaaggttctttttgacccagggggggttattcttaaccgtctgggggaggggggaccaaaactttgtttaaaatcccaaattctgggccctccttggggttaatgtaggggcccttttccttgggggattcaataacttgaaggttttgttgggggggctgggcgaaaatgttataaacctgtttttgaaccttaataatctcctttgccggaagggaaatgtttggggttggcccccg

SEQ ID NO: 6599 - DNA, 633 bp, Homo sapiens
ttcggcacgagggaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctg

SEQ ID NO: 6600 - DNA, 455 bp, Homo sapiens
ctggcctagttattgcttttattattagaaaacataaatatcctggaatgaagagtcagcattctggccacaggcgtcaggtcgcttgtagggtgggtggtggggacagaattgggctcagctcagatgtcttcctaagatggtgtaaaatggcacttgctgaaaattattttaggagcacagcagtaatttttaaaatgttccgtcttgtggtagccggtcaggtgacagatggtgccatcgccacacagtggtgaagtaaaaggttcaaaacccaccttgctttgtctcctttgctccaggttcaagacactaatgaccaataaatcagaacaggatggggacagcagcaagaccatcgagatcagcgacatgaagtaccacatttttcaggtgtgtgggtcttggtgccgccctcttctcagagggatgaccctcccccaggagcccacctt

SEQ ID NO: 6601 - DNA, 472 bp, Homo sapiens; identical to SEQ ID NO: 1876

SEQ ID NO: 6602 - DNA, 603 bp, Homo sapiens
ttcggcacgaggctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgaaattctccccgaggagaggcggagagctgagcttgactaccgaaaagcttttggaaatgagtggaaacaggctggtggacat

SEQ ID NO: 6603 - DNA, 804 bp, Homo sapiens
  misc_feature 704, 706: n = A,T,C or G
tttggctaatttgtctgtttattcccacaaggtagccaggggtgggggctccgagccaagcccagcaggccatgggaccttcctccggcggggtgcacgctggattttcgggtctgccccaccagcaggtttgcaggcaggccgtcatgagtgccggtggaaggctccgagggcgtgggcaggggctcgggcggggccacacacttgtggagctagaaatagtggggcaggtccttctctatcaccaggggctcctccatgggtccgtagcgcttcaccacgcagccgttcttgtcgatgaggaacttggtgaagttccacttgatggcatttcccaggatgcccttgcccttgggttggatcttcatccacttccacagcgggtgggcgtcgtccccgttcacgcagatcttgctgaacatatcgaatttgacgttgtagcccgcgggaaactctttgatctcttcgttactccctggctcctgcttcccgaactggttacacgggaaggccaggatccgcaaaccacactcagcgtatcgggcgtgcaggtcgacgagctgagtgtagtttacttcggtcttgcctcactgggaggccacgttggtgacgatgcacacgaagccccggtacttgtccaggttaaacatgtgcacgtcgatgtccttggcggaaaacttgtgcatggagcgcgcacagcaagntncgtccccgggacgcgcacatggttcccggccaggccaaggcgcgggccagagctccaacagagcaacgccgccttcaataaagggggcaaaggcggcc

SEQ ID NO: 6604 - DNA, 427 bp, Homo sapiens
ggccacagccgcaccagctccccgacacccccttcctctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaatgacatggcaggaagaatggggcctctaaggggagtgtggggt

SEQ ID NO: 6605 - DNA, 505 bp, Homo sapiens
  misc_feature 278: n = A,T,C or G
tcggcatcctccttctcctcctcggcgccgttcctggcttccgccgtgtccgcccagcccccgctgccggaccagtgccccgcgctgtggcagtgctccgaggcagccgcacagtcaagtgcgttaaccgcaatctgaccgaggtgcccacggacctgcccgcctacgtgcgcaacctcttccttaccggcaaccagctggccgtgctccctgccggcgccttcgccgccggccgccgctggcagcgtggccgcgctcaacctcagcggcagcgcctnggacgaggtgcgcgcgggcgcttcgagcatctgcccagcctgcgccacgtcgacctcagccacaacccactggccgacctcagtcccttcgctttctcgggcagcaatgcaagcgtctcggcccccagtccccttgtggaactgatcctgaaccacatcgtgccccctgaagatgagcggcagaaccggagcttcgagggcatggtggtggcggccctgctggcggg

SEQ ID NO: 6606 - DNA, 391 bp, Homo sapiens
tcggcacgagggctcattttttttttttttttttttttcctttcccccggcccattaaccaaacttccgggggcccccaccccgggccttgctttacctggttttgaaaaattttgggggggttaattgggataaaaaattgttggcccctcccaaatttttgggaaagaaaaatggggggttgggctttgaaacccttggggccaacctaagggggttttgtttaaaactgggtttttttccccacctttaaaaaattttcaaattaaaaaggggggtattttaaaaaaaaaccccaaaaattccggttttaaaaaaaatttattggcttggccccagcccttggggccaaattaaaccccttttttcccatttccttttggaaaaaaaa

SEQ ID NO: 6607 - DNA, 325 bp, Homo sapiens
aaaattttttacttatcccatttttcccctttgaccgggaggtttgacccaaaaatttttcctaaaaaatcattccattctccaaattaaaaaaaaagggaaatagctttttatggccataaggtggtttttaaaaagtataaaaatttctttaaaaccctacttgaggctggccatgggaactcccccctgtaatcccacccttttgggaggttgaggcggccaaataacagggccaggaaatcgaaaccttccgggttaataggggaaacccctgtctttactaaaaatacaaaaaattacccggccacaggggcaggcccct

SEQ ID NO: 6608 - DNA, 63 bp, Homo sapiens
ttccgcctcctcaccactgtgcctcaagttcctcatctaagtggccctggcctcctgggggcg

SEQ ID NO: 6609 - DNA, 548 bp, Homo sapiens; identical to SEQ ID NO: 1878
  misc_feature 415, 441, 467: n = A,T,C or G

SEQ ID NO: 6610 - DNA, 576 bp, Homo sapiens
tcggcacgaggactacctggaccgcttcctgtcgctggagcccgtgaaaaagagccgcctgcagctgctgagggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgc

SEQ ID NO: 6611 - DNA, 526 bp, Homo sapiens
gcaccaaagtggcaactaggtcagtgttgggggatcaagctggcctcggggtggggggcccccactgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtcttctccccagctaaagagactttggacttagggggcccatgagcctggagaggccttaaccctgtgaggaagtatagggggagcctctcccacccccatccccttctgagagtggtcaatgtttacaagcccctgagcccccctgcccagggactcagaccctgttgctgtccttccccggccccggtcttcctgggccctcgctgctcccctgcccttcctggggttggggtgggtgcaggggt

SEQ ID NO: 6612 - DNA, 579 bp, Homo sapiens
  misc_feature 469: n = A,T,C or G
tcggcacgagggcccagcatcgtgtggcccctgatgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccanctggtcctgtccttcctgcaccttcatcaatgccccaaaccgccctggctgtgagatgtgtagcacccaaaggccctgcacttgggacccccttgctgcagcttccacct

SEQ ID NO: 6613 - DNA, 377 bp, Homo sapiens
tcggcacgaggctcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttc

SEQ ID NO: 6614 - DNA, 549 bp, Homo sapiens
tcggatccatccaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgc

SEQ ID NO: 6615 - DNA, 640 bp, Homo sapiens
  misc_feature 86, 458, 570: n = A,T,C or G
ttcggcacgagggggactttggggtgcccatcgccatcctcatcatggtgcttgtggattacagtattgaggacacctatacccanaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcangaagtcaaggagcagcgggtgacggggctgctggttgccctgcttgtgggcctctccatagttatcggggatctgctccggcagatccccctggccgtgctctttggaattntcctgtacatgggagtcacctcccttaacgggatccagttctatgagcggctgcatctgctgctcatgcc

SEQ ID NO: 6616 - DNA, 366 bp, Homo sapiens
atgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggctgtctaaagacctaccagcagctggaagtgaaatgcagatcagacccattgtgatgtcacagaaagatggggacaggccaaagaaaaaagtgactttcaactcttcttccatcatttttatcatcaccagtgatgaatcactg

SEQ ID NO: 6617 - DNA, 686 bp, Homo sapiens
ttcggcacgagggggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaagctcaagcacagccagttatgtaaatgtatctatcccaattgagacagctagaaacagttgactgactaaatggaaact

SEQ ID NO: 6618 - DNA, 548 bp, Homo sapiens
cggcacgaggaccttgggacccacttctgcctgcacggaagacttaaagttcacttgcaatacctcaaatcagctatgcatccacagccccagagctaagtgataacaccaggtatgactttttctctcgagtggttccgcctgactcctaccaagcccaagccatggtggacatcgtgacagcactgggatggaattatgttttgacactggcttctgaggggaactatggtgagagcggtgtggaggccttcacccagatctcgagggagattggttatccatccctgtttgggattcaaggctgccttcatgaatgttttgctatactatgtcaagttgtttaccaatttctgcttctaatgcagctgtcagatgctcaaactgtctattagtcgaagaggctctctactgaccacctttctcaagtttcttcttcttacatacaatgtttttgacaagactaagcatatcaaaccatcttttaacaattgtaaagcctaatattggccagcatacaattcaattcattaaacattgtagcactg

SEQ ID NO: 6619 - DNA, 525 bp, Homo sapiens
tcggcacgaggagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcaaactcctgctgcccatgctgtggccggacttgtcagcagggggcctggtgggaggagcgactgccctgcccaaatgaactgccacagcagggacagctggaccgcagagtttatttttgtatttctactgggcctgcacactcc

SEQ ID NO: 6620 - DNA, 458 bp, Homo sapiens
gggcgggacttccgcgccaatccctgagggggtaacatcgcccgccaatccctgagctgggcagggtgggcccgctcacccccctgggctgcccaccccggggtgttcccgccgacttctgggcgggcctcccgggcagtgcctgccgtgggcggggcctgagcagccggactggccaggttcagcgcgcctcagtagggttgtattccgtctctcccgaggacacctgggagatgcgccgcgaggaccgccacagcttccgcgcgaactggctgctgcgcacctcagagggctgccccgcgaccaccacgatgagcttgccatcctccaggcccaccagcacgtggctgcgctccttggtcacggccacgctgcggatggccaccttcatgggcaagggaggcgcggcgggtagcagtgtgtttagttggaggatgtgcagggcgcactgggcggtg

SEQ ID NO: 6621 - DNA, 536 bp, Homo sapiens
  misc_feature 304: n = A,T,C or G
tcggcacgagggcctggggactttcactgatgctcttcctgattctagagcaaagtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctangagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggct

SEQ ID NO: 6622 - DNA, 476 bp, Homo sapiens
ccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctt

SEQ ID NO: 6623 - DNA, 571 bp, Homo sapiens
cggcacgagcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttaatcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccat

SEQ ID NO: 6624 - DNA, 508 bp, Homo sapiens
gggcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctgcaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggc

SEQ ID NO: 6625 - DNA, 522 bp, Homo sapiens
cgcgcgcctggcaggtcgacactagtggatccaaagaattcggcacgagcctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagca

SEQ ID NO: 6626 - DNA, 434 bp, Homo sapiens
acagaaggggatagtcggcgagcaacgctggagcatcccgctctggtgccgctgcagcaggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgt

SEQ ID NO: 6627 - DNA, 583 bp, Homo sapiens
acagagggggggccgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctctacactgcattggtgacccagtgtcagaaaatggacatccctttccttggggaaatgcccgcagagcccatgacgattgatgaactgtatgagct

SEQ ID NO: 6628 - DNA, 536 bp, Homo sapiens
attcggcacgagccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgac

SEQ ID NO: 6629 - DNA, 545 bp, Homo sapiens
cggcacgagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacacaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcct

SEQ ID NO: 6630 - DNA, 557 bp, Homo sapiens
ggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccccgaccatctctgggctccaggctgaggacgaggctgattattactgcagctcatatacaagcagcagcactctcgatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctgga

SEQ ID NO: 6631 - DNA, 440 bp, Homo sapiens
tcggcacgagctctttctgcatcagtattaaggtgtatatttgaatgtcctcccctcccctttcccctccaggctgagtacctttgaggggctgggcgtttgctcacgaccttgctgtctcgctcaaaacatgctccgcaaagttctccgcacacacttcttccccatcaagcccatttccttccccaaccacaaaggtgtttgtgattcctcaccccgggaaaccaaggagctgcaaagtggactctggttcacccccgtgcacactcacccacaccttaacgttgtctttcaaacaccctgagccttcctaaacagccagtgcagacgttctctctgggccacgaatcccctcgggtcctccccgtcccctgctccgatgcatacctcagtgcagaaccacagaatctctgcagcggaaacgccgtgcatctcttgtc

SEQ ID NO: 6632 - DNA, 549 bp, Homo sapiens
gcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcc

SEQ ID NO: 6633 - DNA, 64 bp, Homo sapiens; identical to SEQ ID NO: 6451

SEQ ID NO: 6634 - DNA, 591 bp, Homo sapiens
tcggcacgaggcaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttccttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtg

SEQ ID NO: 6635 - DNA, 506 bp, Homo sapiens
gcatgatgggacagggcctgggtctttaatgggttgagctggggagggcctgtggtgagctcagttgtaggctatgacctggttgatccaggtgctgaacttgctaactcgagtatacacagcaggtgcgcgcacattgcagtttttggtgccccaggagacaataccaataagcacccatgtgtttcccttctggcagacaagagggcctccggagtcaccctggcacgaggaggcacctgcgccacctgcacagatcatggagtcagtgatacttgagccccagtactgccggcactgattcacagtgaccaggggcaaagcacctgctgcagacgtgctggtgtcacattgcccacgccactgaggcgaccccagccggtggtgacacacgtgaggccttcagtcagagcctcgtttgaggatgccaggcaaactggcgagatgcgtgttgtgtactgggctggcgaggcgagcttcagcagcgtcacgtcattgttcatggt

SEQ ID NO: 6636 - DNA, 512 bp, Homo sapiens
  misc_feature 277: n = A,T,C or G
tcggcacgaggcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcanggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctc

SEQ ID NO: 6637 - DNA, 86 bp, Homo sapiens
ctggatgctcctgtgctgaaccaggctgagtgtgaagcctcctaccctggaaagattaccaacaacatgttctgtgtgggcttcct

SEQ ID NO: 6638 - DNA, 605 bp, Homo sapiens
tcggcacgagggcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaa

SEQ ID NO: 6639 - DNA, 385 bp, Homo sapiens
gcgtaaaggctggagctgctgtaggctggggatggggccgagtaggggcccgagccgaggacgtgctccaaggagaactggcggctatacttgggcatggaatgtgctgagccactgtcgatcaacatcagggggatctttgtcttgacccccaggatccggttggactgcaccagtgagatcaggaactgaatgaccttggtgacgactttctgttgctgggcatgcttctgccgaaggctggccaccttccgccacagagcctcattctcatgcttcatggccaggagcttggagtccatgcactgctgcttccccttcattagctgcacgtacgtcatcagcttggtgacgctgacctggcggatctttatgtcttcactct

SEQ ID NO: 6640 - DNA, 517 bp, Homo sapiens
  misc_feature 404, 433: n = A,T,C or G
tcggcacgaggaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcangactttccctgacagctgtgtactcttangctaagagatgtgactacagcctgcccctgactgtgttgtcccagggctgatgctgtacaggtacaggctggagattttcacat

SEQ ID NO: 6641 - DNA, 501 bp, Homo sapiens
  misc_feature 306: n = A,T,C or G
ttcggcacgaggtggaaacggcgttttccacaacagggagccagcattgaggcgcccagatggcatctgctggaaatcacgggccgctggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttangaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgctt

SEQ ID NO: 6642 - DNA, 386 bp, Homo sapiens
atcgatgaacttcaacttagctttgttttccacagactggagctaaactgggctttcaacatgatcatgaactttatcctactctgggccctcttgaatctgactgttgctttggcctttaatccatattacacactcagctccactcccccttacttggtctattagaaatctgactacttgccctgcgctggagtcctgatccacccgctttgggtgatcacagctgctcactgcaatataccaaaacttcaggtgatattgggggttacaatcccagcatactctaatgaaaatcatctgcaagcgattggctctgaaaatatgattcatcatccacacttctcaatcacttctattgatcatgacatcatgctaatcaagct

SEQ ID NO: 6643 - DNA, 83 bp, Homo sapiens
gggacctaccgtggggtgaacctgcgcatcattgcagcccatgaagtgggccatgctctggggcttgggcactcccgatattc

SEQ ID NO: 6644 - DNA, 559 bp, Homo sapiens
  misc_feature 316: n = A,T,C or G
tcggcacgagctgtgatgtccctcagtgtgcggccccttcatttgattgtgggaagcctcaagtggagccgaagaaatgtcctggaagggttgtaggggggtgtgtggcccacccacattcctggccctggcaagtcagtcttaaaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctangctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttgggagctggccttctcaaggaagcccagctccctgtgattgagaataaagtgtgcaatcgctatgagtttctgaatg

SEQ ID NO: 6645 - DNA, 790 bp, Homo sapiens
caaatttctttcttttttaatttagattgagttcatttatttgaaacagactgggccaatgtccacaaagaattcctggtcagcaccaccgatgtccaaaggtgcaatatcaaggaagggcaggcgtgatggcttatttgttttgtattcaatgattgtctttccccattcatttgtctttttagagcagccatctacaagaacagtgtaagtgaacctgctgttgccctcagcaacaagttcaacatcattagagccctgtagaatgacagcctttttcaggttgccagtctcctcatccatgtatgcaatgctgttcttgcagtggtaggtgatgttctgagaggcatagttggccagcaggcgcatgaaggcaagttgggtagccatttccttggaagtcactccttctacattatattcaaactggctgccagcattgatagtttctcctagccagacgtgtttcttgtccttggagctcctataccagttcttggctgggatgttttcaggttgggcccggatacaggtttcgccagtagagaaatcacagtatactttgatagcatccatagtgcatccttggttagggtcaatccagtagtaaccactgctccactctgggtggctgagtctcaagtcacggcatgtgcgagctgggttctttctagagcctttcagagttaagaagggcttaaatctgtttggtgagagacttcagagtagcatcaaactcatagtcccttggtctgagaagaagtgcctgacgaagctggtcagccctgta

SEQ ID NO: 6646 - DNA, 557 bp, Homo sapiens
ttgacccagcctcaccaggccgggcccctctgctcaggaccaggccccaccccagtgccgccctgaggcctggcaggggcctctggagcccgcacacccctctccttggcagccccctccatcctgggcccttcgtctttcccacaggtgtgtccctcaggactttgcagccagggtgtggccggccgcaggtttcggatgcaggcggccggatcgtggggggtcacgctgccccggccggcgcatggccatggcaggccagcctccgcctgcggaggatgcacgtgtgcggcgggtcactgctcagcccccagtgggtgctcacagctgcccactgcttctccgggtccctgaactcatccgactaccaggtgcacctgggggaactggagatcactttgtctccccacttctccaccgtgaggcagatcatcctgcactccagcccctcaggacagccggggaccagcgggatcctgcccgtctgcctcccggaggcctcagatgacttctgccctgtgatccggtgctcggtgaccggctggggctatacgcgg

SEQ ID NO: 6647 - DNA, 488 bp, Homo sapiens
ttcggcacgaggcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccg

SEQ ID NO: 6648 - DNA, 553 bp, Homo sapiens; identical to SEQ ID NO: 1896
  misc_feature 325, 431: n = A,T,C or G

SEQ ID NO: 6649 - DNA, 594 bp, Homo sapiens
  misc_feature 457: n = A,T,C or G
tcggcacgaggcgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttantctaaacctgtggcctctgccacgtgctccctgccagcttcccccctgaggttgtgtatcatattatctgtgttagcatgtagtattttcagctactctctattgttataaaatgtagtactaaatctggtttctgg

SEQ ID NO: 6650 - DNA, 473 bp, Homo sapiens
tcttcctcttttttttcccctcctatccctattcacgcaggagctgctcttctggggtatcgcgatccacttaaggatgatgcatacttggtgacaatctggtctgatcatcgcttccagagccagaactgaccccagcgagagcgcaccctggggcaacctggattcctggggtgtccccggcagccacacacagccatgcactacccaactgcactcctcttcctcatcctggccaatggggcccatgcctttcacatctgcgccttcaatgcccagcggctgacactgtccaaagtggccatggagcaagtgatggacaccttagttcggatactggctcgctgtgacatcatggagctgcatgatgtggtggactcttccggcagcgccatcccgctcctgcttgaataactcaatcgatttgatggctctgggccctacagcaccctgagcagcccccaactggggcg

SEQ ID NO: 6651 - DNA, 552 bp, Homo sapiens
ttcggcacgaggcacgatgccgtcagcagggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcattttgaactgggaggagataagaagagaaagggccaagtgatccagttctaagtgtcatcttttattatgaagacaataaaatcttgagtttatg

SEQ ID NO: 6652 - DNA, 90 bp, Homo sapiens
cgggccgctccatccatgaaatcccgcgcgaggagctgcggcacacgcccgagctgcccctggtcccgcggccgcaagcttattcccttt

SEQ ID NO: 6653 - DNA, 606 bp, Homo sapiens
  misc_feature 498, 542: n = A,T,C or G
gcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttncacagctgccagtgtccctagagtttatcaggtgaattggtcanggatcagtctccctcgagcctgacttacggctgggacagccccatctttctgttgatatgtggc

SEQ ID NO: 6654 - DNA, 388 bp, Homo sapiens
  misc_feature 324: n = A,T,C or G
cattattacccagaaatctttattacaaaaatattttgcaagccaaaaagtttaagttgcaactatatacaaaatggggcctgtttccttcccagcagtcttaaaataaactcctgaaaccatgctccttccgcagggttcggttcgacctcttccttttcctggggttcaatacacaaggtatgtggattctccaggttgccaggctaaagctaaagctatacatcttccttggccttattcccttatttccccctccaagaattaaaaaataaaataaaatgaaaatggcaccaagaaaacattcttttaaaatactgaatntgtgtgtgcatgcgtgttgcacacgtatgtgctgtctcctgggtaaaaagaagagggagacgaa

SEQ ID NO: 6655 - DNA, 646 bp, Homo sapiens
gctgaccccctccggccctctggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcaaaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcag

SEQ ID NO: 6656 - DNA, 401 bp, Homo sapiens
tcggcacgaggcttgggattaattctttttttttttttgaaaggagtctcgctttgccaccaaggctgaagggcaggggggcaatctgggttaattgaaaccttaacctccggggttaacccctttttcctgcctaaccctcccgaaaagttggaactacaggcccctgcccccatgccgggttaatttttggaattttaagaaaaaatggaatttcaccgggtaacccaggagggcctcaatatcctgaccttggaatccgcccgccttgccctaccaaagggctggaataacaggcataacctgtcatgccgggccggaataaattttttatccatgtaatcggcataattttggattttcggctatataagggaatatgggaaaaacccattcccttt

SEQ ID NO: 6657 - DNA, 466 bp, Homo sapiens
  misc_feature 61, 396: n = A,T,C or G
acagccgcggcgcgaggaggcagtgagcgccctgtgttggggcaccggcggcgagacccanatgctggtgggctgcgcggacaggacggtgaagcacttcagcaccgatgatggcatattccacggtcagagacactgcccgggcggggagggcatgttccgtggcctcgcccaggccgacggcaccctcatcacatgtgtggattctgggattctcagattctggcatgacaaggacaaggacacatcctctgacccactcctggaactgagagtgggccctggggtgtgtaggatgcgccaagacccaccacacccccatgtggttgccacaggtgggaaagagaatgctttgaagatatgggacctgcatggctctgacgaacctgtgttcanggccaagaacgtgcggaatgactggctggacttgcgggttcccatctgggaccaggacatacagtttctc

SEQ ID NO: 6658 - DNA, 181 bp, Homo sapiens
tcggcacgaggatttatgtaccatattatacctttttattgttgttataattattatgggtatttctaattaatatgatgttgaaacctgtttggcaccttctggaagctaccaaaaaaatgacactccattgaagtgcttaaaagctgttctcataagaattctactggcctattgtaaa

SEQ ID NO: 6659 - DNA, 563 bp, Homo sapiens; identical to SEQ ID NO: 1903

SEQ ID NO: 6660 - DNA, 522 bp, Homo sapiens
  misc_feature 462: n = A,T,C or G
cggcacgagtgaaaaacctgaaagatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaagactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactanggcagtggggagacgtcttaactctgctgcttcccaaggatggctgtttataatttgggg

SEQ ID NO: 6661 - DNA, 535 bp, Homo sapiens; identical to SEQ ID NO: 1905
  misc_feature 446: n = A,T,C or G

SEQ ID NO: 6662 - DNA, 458 bp, Homo sapiens
tcggcacgaggcgccccgtctccgccgccgcacccctgtccagctgttgagctgcccgccccacctgctcaagtctaactccgaggccagcctcctccagctgctggcaggggctggcacccatgggacaccctctgcccccaaccgcagcctgtcagaactctgcctggctgttccacccccagtattaggactcaaggctcccctcacgaagctgggcccagctgggattgccgacgggcccctaaccctggcagcggtcctgggctactcggctgcctggccggggaacctgcacgctcccacaggaagatgtgtggagacctgccctcgggggcctctcccagggtccatcctgagcccccaccacgggtctctgcccaccacacgaagctgaccctggcccagctctaccgaatcacgaccaccctgctgcttaactccacgctcactgcctc

SEQ ID NO: 6663 - DNA, 275 bp, Homo sapiens
ggggccccaaaaaatttttttttaaaaaaccgaaaaccgggccctttggcccctaaaatggaaatttccccatccttcctttaaaggaacctaaaaaaaccgggttccctaggggggctgggcccctgtttaattttttggaaaaggaaaacccttttagggtttctgggggccctggggttttaccccccggaaaaaaagggccttggtttggaaattttttaaccaaggggggacaccaaagggcaaaacggaaaggttgggcggaaaaaggg

SEQ ID NO: 6664 - DNA, 509 bp, Homo sapiens
  misc_feature 315: n = A,T,C or G
tcggcacgaggacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctanacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattc

SEQ ID NO: 6665 - DNA, 619 bp, Homo sapiens
tcggcacgaggcgcagcccgactagcagtctaaaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgct

SEQ ID NO: 6666 - DNA, 620 bp, Homo sapiens; identical to SEQ ID NO: 1908
  misc_feature 431: n = A,T,C or G

SEQ ID NO: 6667 - DNA, 529 bp, Homo sapiens
tcggcacgagggctcatccacggccaacctcatctttgaggactgtcgcatccccaaggacagcatcctgggggagccagggatgggcttcaagatagccatgcaaaccctggacatgggccgcatcggcatcgcctcccacgccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgtgctgccatgctgaaggataacaagaagcctttcatcaaggaggcagccatggccaagctggctgcctcggaggccgcgaccgccatcagccaccaggccatccagatcctgggcggcatgggctacgtgacagatatgccggcagatcggcactaccgcgacgcccgcatcactgagatctacgagggcaccagcgaaatccagcggctggtgatcgccgggcatctgctc

SEQ ID NO: 6668 - DNA, 285 bp, Homo sapiens
atacgaacatgtatgcacacaaaacatttaactatggtatttatggaagacaggtaacaacattaaatctagttgctttcccttactattagatctgttgagggttttttaaaaatcaggtctgttgaaagtcttctgtcataatctataaagcaccatcactcatgtgaaattgtagcatgccagtaatttttactcaccatcccatacatatgatttctgcagtccagtgtgtaatccgctccatgtgtattttgcttaatggaatgctttatttaagcactt

SEQ ID NO: 6669 - DNA, 598 bp, Homo sapiens
atcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgaggtccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttcagaaggaccgcaagatggcactgattcagatgggctccgtggaggaagcggtcaggccctcattgagctgcacagcacgacttcgggagaacaccacttgcgggtctctctccaagtc

SEQ ID NO: 6670 - DNA, 620 bp, Homo sapiens
  misc_feature 351: n = A,T,C or G
tcggcacgagggctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctanaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaat

SEQ ID NO: 6671 - DNA, 558 bp, Homo sapiens
  misc_feature 475: n = A,T,C or G
tcggcacgaggctgaatctgaccctgcttcccacccccacccttgtaagagcacctgtgggcatggaggggaaggatctggggctgatctaaatgtcttctctcctttttagacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaagggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccangcactcaccgcctcctccctggtacacaggcttctgtggggccaccaagcccctcctgtgccccctcccatccatagtgcatg

SEQ ID NO: 6672 - DNA, 479 bp, Homo sapiens
  misc_feature 331: n = A,T,C or G
tcggcacgaggggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctanaggccaggcaggagcccttctatacccacccagaatgagacatccagcagatttccagccttctactgctctcctccacctcaactccgtgcttaaccaaagaagctgtactccggggggtctcttctgaataaagcaattagcaaat

SEQ ID NO: 6673 - DNA, 438 bp, Homo sapiens
atccacagcctcagcctcccagagtgctggaattacagaattttgaacatattcctccatcatgttccggttcccactgacgctgttaaagaatccagtgccattcggatccatgatcctttgtatgaaatccactttttctctgcaaacttgtaggatattttcttcatgccagatacttgtgttcttcaattctgggtttttgaaaacaaaatatttttaaaattactttcttctttctttttttttaggacagagtctcgctccgtcgcccaggctagagtgcagtggtgtgatcccagctcattgcagcctcaaacccctgggctcaggtggttctcccacctcagccccccaggtagctaggactacaggtgtgtgccaccagtcctggctaattttttaattttttttttgaaaacacttatgcctattgac

SEQ ID NO: 6674 - DNA, 279 bp, Homo sapiens
tcggcacgaggtttttttttttttttttggggtcccaacaaacttttttttacaaaaacagaaaccaggccctttggcccctaaaactgaaatttccccatcactactttaaaggatcctaaaataacctggttccctaagggggctgggcccctgtttaattttttggaaaatgaaaaccactttagggtctcctggggccctaaggttttacacaccggaaaaacagggcactgctttggaaattttttaaccaaggggggacagcaaagggcaaaa

SEQ ID NO: 6675 - DNA, 454 bp, Homo sapiens
gcggccgcagagccccggcgggcagccctgagctccccagctggttgtgctgcagcaacaaatagcgcagaccacgcgccccgtgcagccgagccgcctccacctgccggatgcggttgcggcccaggtgcaggatagccagggtccggggcaggccggcgggcactgtggtcagctggttgtgggagagatccaggtattcaaggctatgcagcttgctgaaggtggtggcatccaggccactgtctgtcagctggttgtgctggaggtagagctcacggagttgagtctggcggctcagggctcctcggggcaccttggagatgagattgttagcagggctacctgcatgtggagccgctcgagtgagggcggcaggctgggcggcaggtagctgagctggttgttggagaggctgagggtggcgatggcctcggagccgcggaaggcgtcg

SEQ ID NO: 6676 - DNA, 419 bp, Homo sapiens
acgcggttgatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgc

SEQ ID NO: 6677 - DNA, 523 bp, Homo sapiens
ttcggcacgagggttaaaaattatctggaattaaaagtaaggctgttttttcttttttctcttacccattattaggtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattca

SEQ ID NO: 6678 - DNA, 627 bp, Homo sapiens
ttcggcacgagggccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacgtgctcctgctctcaggaccgtgccctcgtcagctgggatgtgaagtctctgggtggaagtgtgtgccaagagctactcccacagcag

SEQ ID NO: 6679 - DNA, 705 bp, Homo sapiens
  misc_feature 548: n = A,T,C or G
ttcagttttttaagatttatttcaagtgttgtgcaaagagggcttatgcaattcttcagaccctatttattttatttatttatttatgtacattcttctggaaaggattactaaagccaaactaagaaaagtatgtaagtgatggattatcaggcgcccttgtttgaggtcagagtaaacagacagactcccgataggttggtttaaaagtagatacctagattgcctggaagcattcaactcagctttgtgggagcatttggtcaaacttccaagtcattgttttttttgtgtgtgttcattttgttacttttccagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacanaacccccatccagcctggggaagagtgtcactctgtgggaaccaattctgatcagtacatctgggtgaaaaggagcctgaactgtgtgctcaagtgtgctatgatgcttgcttatacagccgctcagcccaagaagtcactggatatctggatggct

SEQ ID NO: 6680 - DNA, 425 bp, Homo sapiens
ttcggcacgaggatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatc

SEQ ID NO: 6681 - DNA, 552 bp, Homo sapiens
tttctcactgcagcatgtagcaaattagactggccacctggagacccaggtcctcattcaggttatgctcacagaatgtgttacccggaaagagctgaagtctagggcctcagtttccccagtgcactggtggcaggtgggcctggctgagtcccagcccctcaggctctggcctctatgtccctacattctctccctgcaggaggctccactgcactcgcaactacatccacatgcacctgttcgtgtccttcatccttcgtgccctgtccaacttcatcaaggacgccgtgctcttctcctcagatgatgtcacctactgcgatgcccacagggtaatatgtctgggtgccccaggatgtcgccaggcccgcctgccttccccagcctagctttggagaggggagtagcctagttgtccttcccccaagcccctgctgaggctgcatttaataccaaggataaagcagccagtgctgacactgggccaggaggttcagggagattccacagccacatgtgcacaatctgggtcatgtaggagagaagctc

SEQ ID NO: 6682 - DNA, 595 bp, Homo sapiens
  misc_feature 289, 293: n = A,T,C or G
tcggcacgaggatgatccgtcagatctctagaccctcagctgctggtatcaaccttatgattggcagtacacggtatggagatggtccacgtcctcccaagatggcccgatacgacaatggaagcggatatagaaggggaggttctacttacagtggtggaggctatggcggtggctatagcagtggaggctatggtagcggaggctatggtggcagcgccaactcctttcgggcaggatatggtgcaggtgttggtggaggctatagaggagtttcccgaggtggctnttanaggcaactctggaggagactacagagggcctagtggaggctacagaggatctgggggattccagcgaggaggtggtaggggggcctatggaactggctactttggacagggaagaagaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgat

SEQ ID NO: 6683 - DNA, 464 bp, Homo sapiens
  misc_feature 42, 47, 95, 375, 401, 420, 438: n = A,T,C or G
ctccgttgttggtccactgcagtgctggggtaggaaggactngcgtngtgattttgtcggagatcatgatcgcctgcctggaacacaatgaggtnctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttggacacttgatccacgcagcgtgggcactggggacgtaagttggcgcagtcttgaatgggcggcacttngaaagggaaacgtggcggacaagggncttgaaggagggggttttntaacctggggaaaggttnttcaagggaggatttggttttcaaaa

SEQ ID NO: 6684 - DNA, 496 bp, Homo sapiens
  misc_feature 436, 491: n = A,T,C or G
atatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggctacatctggatgccaacaccagatatgagcaccgaagccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggcggcctgtctacaattgaccgaagnaggcagctagcccaggacacatttccactattattttacaaagttaaatttatangcttt

SEQ ID NO: 6685 - DNA, 230 bp, Homo sapiens
tcggcacgagggcctgtaatcccagctaaccaggaggctgaggcaggagaaatcacttgggcccgggaggcagaggttgcagtgagccgagaccatgccactgcactccggcctgggtgacagggcaagactctgtctcaaaaaaaaaaaaaaaaaattacccccacatgggtaacttaacaaaaatggattctaacagttttggaggcccaaagtctaaaataaaagtg

SEQ ID NO: 6686 - DNA, 222 bp, Homo sapiens
gaagctggtacgcctgcaggtaccggtccggaattcccgggtcgacatcatcatgatcgctcgacatcgatacgactttttttttttttttttttttttttgggaaaggggggattttttaacccccccgggggtgggtaaaaggctttttggggggaaggccccccttgccgggaaatttgccaaaaattttttgcccctttgggggtttttccccacccc

SEQ ID NO: 6687 - DNA, 542 bp, Homo sapiens
  misc_feature 516: n = A,T,C or G
atcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctcctttgcgctatttggaaattttagttatagtgtttaactggcnggggggggttttttgtggtgtggggg

SEQ ID NO: 6688 - DNA, 358 bp, Homo sapiens; identical to SEQ ID NO: 280
  misc_feature 320, 323: n = A,T,C or G

SEQ ID NO: 6689 - DNA, 363 bp, Homo sapiens; identical to SEQ ID NO: 1918

SEQ ID NO: 6690 - DNA, 571 bp, Homo sapiens
gacagagggggttttcctctggacctgggaaccactggcttactttcactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccagggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgggagcttacttgctcaaccgcactctatgggatcggtgcgtggcgccccctcgcgtggtcccctggaatgtgacgctcttctcgctgctggtggccg

SEQ ID NO: 6691 - DNA, 617 bp, Homo sapiens
ggatgctcagcgcgctgcccggctggggacccacgcacctgcagcgcccgctgctcggccctgcatcctgcctgggcatcctgcgcccgaccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttccc

SEQ ID NO: 6692 - DNA, 525 bp, Homo sapiens
gacagaggggcgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcaactgattcagagtaggctacaagaagagcgttcacttcaagatgtgatat

SEQ ID NO: 6693 - DNA, 538 bp, Homo sapiens
gggtgtgaggatccgaacccggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgacttcaaatgcttctgatgctttagataagataaggctaatatcactgactgatgaaaatgctctttctggaaatgaggaactaacagtcaaaattaagtgtgataaggagaagaacctgctgcatgtcacagacaccggtgt

SEQ ID NO: 6694 - DNA, 486 bp, Homo sapiens
cagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgat

SEQ ID NO: 6695 - DNA, 413 bp, Homo sapiens
ggcacgaggcctcagtcttccagggcggcggtgggtgtccgcttctctctgctcttcgactgcaccgcactcgcgcgtgaccctgactccccctagtcagctcagcggtgctgccatggcgtggcggcggcgcgaagccggcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccg

SEQ ID NO: 6696 - DNA, 569 bp, Homo sapiens
ctcatcttccaggcggcggtgggtgtccgcttctctctgctcttcgactgcaccgcacttcgcgcgtgaccctgactccccctagtcagctcagcggtgctgccatggcgtggcggcggcgcgaagccggcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaagacaaggtgctggtggcggcgcggaggaacgcctcggccgtcgtcctctacaatgaggagcgctacgggaacatcaccttgcccatgtctcacgcgggaacag

SEQ ID NO: 6697 - DNA, 548 bp, Homo sapiens
ttcggcacgagggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttacttctgtccatcttgcacggcatactcccacgggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttgg

SEQ ID NO: 6698 - DNA, 717 bp, Homo sapiens
  misc_feature 317, 497, 576, 616, 627, 714: n = A,T,C or G
caagctttctagtaatttaattttatcaaaacaccctcccctcctatctttatgacaccatttaattcttgccaaattcggtccacccccacacacacacccccaagctctaccaaatgcctactcaaagagctgttggacccctttgtgcggctatttacatcctccctcctaaaaaatattttcatcgcaaattcagtctgtcttaattctctcgggaaattccaggcacaataatttcttggcctttgctcagaagccactatcccagggaatcaaagaagaggtgcattcccagatgtagagaggggcctttntgtattgagtgggagcacaaaggctccagggctcctaagcttgggatttcctctgagaaagtgaaattggggcttgtggagaagagaagtagaacccagaagcttattggcgagctcaggaatcttcatccatgacatctagaatattgctcagaagaaatttgaagtgggacgctcatnctgcttctcatgcccagcactgtacatgatggtatataccttctctgaagccagatgaggcctgtagagacgtaggccntggggcatgtgttcagcagtctcactggtagtaaatctcntcatatgcatnctcccccaggagtaaaattccacatcaaaacccaaaagccaaatgtcagattgctgctgaactgctaacatcaggacttcggtgggngac

SEQ ID NO: 6699 - DNA, 505 bp, Homo sapiens
ttcggcacgaggccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaagaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccg

SEQ ID NO: 6700 - DNA, 538 bp, Homo sapiens
tcggcacgagggaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccact

SEQ ID NO: 6701 - DNA, 592 bp, Homo sapiens; identical to SEQ ID NO: 1926

SEQ ID NO: 6702 - DNA, 514 bp, Homo sapiens
tcggcacgaggctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgaccc

SEQ ID NO: 6703 - DNA, 460 bp, Homo sapiens
  misc_feature 307: n = A,T,C or G
tcggcacgagggatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcctgtcatgagcctttangtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacat

SEQ ID NO: 6704 - DNA, 173 bp, Homo sapiens
tgccatgtgcgtttgctctgtggggaacagagcacacagggtgagcgacatgtgcataacggccccttggctgcaattatgacctcattggctggtatggccaacctgctaccaagatgctgctgaccctgtgatcccaacagccctcccttgaccgtgacccctgacctttg

SEQ ID NO: 6705 - DNA, 449 bp, Homo sapiens
  misc_feature 306: n = A,T,C or G
gtcgcaccatgccatgcgaagcccagccctgcagagggtcgctaaggtgcccagctcttctggggggcttcgctgtctctgatgtgcgcatggatccagtcgaggtagcggctgactttggtgtaaacgccgtagttgtgaaggagcccacaggcctcagcccagctcagcaggcccaccagggaccaggtgccgtggaaggaggcgaccatgggccccccactgtcgccgctcgaggcatcctggcggtccccgaggatgcccggacaaagcatgttctcagacaccatgttgctcatgagctcnctgcactcattgttcgggaccacgggaatcttgatgaagttgaggaccaaggtgcggtttctcttgggctgcttctctcggctgctgtggtagccccaggccgtcacgagggtctcctggccgggctgattgagctcgcctct

SEQ ID NO: 6706 - DNA, 467 bp, Homo sapiens
tcggcacgaggcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagaacccgttgccgagcctggcgctgtcggagctgtcggtgcagcatgcggactcactggagaacatcgacgagagcgcggtggccg

SEQ ID NO: 6707 - DNA, 569 bp, Homo sapiens
  misc_feature 504: n = A,T,C or G
tcggcacgagctcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcancctccttgctgccctctgactctgtgtgccctccctcacttgtgggccccccttgcctccgtgcc

SEQ ID NO: 6708 - DNA, 96 bp, Homo sapiens
gggcacccgggtcacaccaagcactgtcagctctgtgatcagcagctgcccgggcctgctctacctcaacctggagtcctgccgctgccttccccg

SEQ ID NO: 6709 - DNA, 520 bp, Homo sapiens
agtggatcccccgggctgcaggaattcggcacgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaagcggatgatgggcgtcccttcccccaagttatcaaatccaagggcggtgttgtgggcatcaag

SEQ ID NO: 6710 - DNA, 473 bp, Homo sapiens; identical to SEQ ID NO: 1932

SEQ ID NO: 6711 - DNA, 473 bp, Homo sapiens
  misc_feature 150: n = A,T,C or G
tgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctanacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggag

SEQ ID NO: 6712 - DNA, 50 bp, Homo sapiens
tcccccggacttatttttttgctttgcccgtggggcccaggcggggaact

SEQ ID NO: 6713 - DNA, 487 bp, Homo sapiens
  misc_feature 370: n = A,T,C or G
tcggcacgaggaggccatggacttcctggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcanggaaaccagggtccggggcaggcccggcgctttgctccccacaccagccccctgcgcgtgtccactctgatcctgcatcccactccctgggagccaataaagtgcattttcacaggc

SEQ ID NO: 6714 - DNA, 356 bp, Homo sapiens
aaaactcaagtctattacttgtagagtccaattcttagcactggaatccctctaggattctaatttgggctttgtctggatttgcttttctcagttgtgctttgaagtgaataacctttgttacaaattaattttttattagttccaatattagttggagttaacttgaattgattgtatgtagcacatcacttttgcagtaagattggtgtgaaatactaaacactatggattttgtatgtgtcaggttaaatggtcaagggatacctacattaagtcatatattaggtattgatgatcttacttcttttctgttcccctgtacaaaacacttacctaacccagcttgtggtttt

SEQ ID NO: 6715 - DNA, 444 bp, Homo sapiens
  misc_feature 22, 89: n = A,T,C or G
gcacagcaacaagtacgaagantggcccgagggctggagatggaaggctgtatcccgcggagaagcacggccagctagcacggccagtncagggaccgggccgagggaggcagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctgggaacgggcctgggtgcctgcccctcactgtgcatctctgggagca

SEQ ID NO: 6716 - DNA, 560 bp, Homo sapiens
ctgaacgcaggcacatacttactattctacaccctactaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatattacttgccgcagtactcttaaaactaggcggctatggtataatacgcctcacactcattctcaaccccctgacaaaacacataccctaccccttccttgtactatccctatgaagcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcct

SEQ ID NO: 6717 - DNA, 410 bp, Homo sapiens
  misc_feature 392: n = A,T,C or G
ggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggaacagatctgctggtatcagaagccgggcttgggtttggatgccatcaatgatggtnaacctcctgggaagcatg

SEQ ID NO: 6718 - DNA, 195 bp, Homo sapiens
  misc_feature 4, 10: n = A,T,C or G
gganctggtngctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgc

SEQ ID NO: 6719 - DNA, 466 bp, Homo sapiens
atttgtctgactgtgttggggctgggccacttgtctccaactcataagggcttgcagcccaattgacccgatgtttcatggaacagtcacagaagaactaaccagtcatgaacaatggagtcgctataatgaaaacataagagaaggtcaaaaagattttgtttttgtgaagttcaatggccttcatttaaagtctatggaaaatttgcagtcttgcatctctcttacagtatgcatcttctcaaacaatgttattacagatattcatccacttcaaaggtgtataaaattaatcaaacttgatctccatggaaatcagataaagagtctaccaaataccaatttttggaatggattgaagaacctaaaactactctatcttcatgacaatgggttagcaaagttaaagaatatatgtgtattatctgcctgtccaaccctcattgccctcactatgtttgattgc

SEQ ID NO: 6720 - DNA, 524 bp, Homo sapiens
  misc_feature 520: n = A,T,C or G
gaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggacacctgttgttcatctcccaggtcagccacagcgtatgatgggtcctctctcacaagcatcaaggtatataggcccgcagaatttttaccaggttaaagacattcggaggccagaaaggcgccatagtgacccttggggtaagggcaagaccaacagcaactggatagggccatttaataggggtaaaggggaccgccagagattttatagtgattcacaccattttgaaaagagagcgacatggaaanggat

SEQ ID NO: 6721 - DNA, 561 bp, Homo sapiens; identical to SEQ ID NO: 1936

SEQ ID NO: 6722 - DNA, 628 bp, Homo sapiens
tcggcacgagggttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtccttaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccgtacccgggaccccagcagccttcataccccttccc

SEQ ID NO: 6723 - DNA, 150 bp, Homo sapiens
cccttactttttttaaaaggcggggttaaaaggttaataaccaaggcccttttgaggtttcttgcaaggcaaaaccccaaaaaggggcctccttggaaaggcccccccgtccattcgggggccaaggggaaccaaggggccctccttttc

SEQ ID NO: 6724 - DNA, 353 bp, Homo sapiens
cggcacgaggtgaataacttttttattttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagatt

SEQ ID NO: 6725 - DNA, 549 bp, Homo sapiens
gcatcataaattgaactctgaactttggaaacctgaatccttcaggaaagatttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttatt

SEQ ID NO: 6726 - DNA, 523 bp, Homo sapiens; identical to SEQ ID NO: 1937
  misc_feature 460: n = A,T,C or G

SEQ ID NO: 6727 - DNA, 586 bp, Homo sapiens; identical to SEQ ID NO: 1938

SEQ ID NO: 6728 - DNA, 671 bp, Homo sapiens; identical to SEQ ID NO: 1939
  misc_feature 472, 494: n = A,T,C or G

SEQ ID NO: 6729 - DNA, 497 bp, Homo sapiens
tcggcacgagggcggagacggccctcaggggaagagcagccctgtcctgaagaagacccccaacagggcctggtacaggtcaccacgcaccgactatgtcgcctgccaccgagccgggcccacctccccaccaaggaagcgtccagcctgcatgctgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggccggctggatcctgc

SEQ ID NO: 6730 - DNA, 602 bp, Homo sapiens
  misc_feature 457: n = A,T,C or G
tcggcacgaggatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattanctgcctcaactccaatgagctgctgcctctgttgctggatcgagccaccgacctgatcttggaccacatccgtgagcgaagccaggggccctcactggggccgtgacactagtggccatggctgcctgcctgactgtagtgccca

SEQ ID NO: 6731 - DNA, 515 bp, Homo sapiens
cggcacgaggggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggcccccgaagcttaccctgtctttgagccagtgccacctgtccctgaggcagcccagggtgacacagaggactcggagggtgccccccccactcaagcgcatctgcccaaatgcccctgacccctgaaaagccggcctgcctgtcctgttgcccc

SEQ ID NO: 6732 - DNA, 522 bp, Homo sapiens
gtgctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgacttaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggcctgcctggctcaacgtgtcacagatggtgacaacgtgcattggtttgaatgttctgagg

SEQ ID NO: 6733 - DNA, 601 bp, Homo sapiens
  misc_feature 548: n = A,T,C or G
tcggcacgaggcctcgttccgaattcggcacgagggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctatttcccaaggcgtccgcgcgccagcacagaaacagaggagagtcccagatcatgaggcccctggcccagcggcccctcccacacacacccacacactcgcccgcccactgtcctgggcgccctggaagccggcggcccaagcccgacttgctgttttgttctgtggttttcccctccctgggttcanaaatgctgcctgcctgtctgtctctccatctgtttggtgggggtagagctgat

SEQ ID NO: 6734 - DNA, 495 bp, Homo sapiens
ttttggtaaggttgaatgcacttttggtttttggtcatgttcggttggtcaaagataaaaactaagtttgagagatgaatgcaaaggaaaaaaatattttccaaagtccatgtgaaattgtctcccattttttggcttttgagggggttcagtttgggttgcttgtctgtttccgggttggggggaaagttggttgggtgggagggagccaggttgggatggagggagtttacaggaagcagacagggccaacgtcgaagccgaattcctggtctggggcaccaacgtccaagggggccacattgatgatgggcaggcgggaggtcttggtggttttgtattcaatcactgtcttgccccaggctccggtgtgactcgtgcagccatcgacagtgacgctgtaggtgaagcggctgttgccctcggcgcggatctcgatctcgttggagcccttgaggagcagggccttcttgaggttgccagtctgctggtcca

SEQ ID NO: 6735 - DNA, 555 bp, Homo sapiens
  misc_feature 454: n = A,T,C or G
ttcggcacgagggttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgtggtctttgattgcagccattcaatgcccacatgcttttccttcttgtttcagaacagcacatggtcacaacaagatattttctttccctccaaagccttttgtctccttgtgcctctttttatccttangaaaagatccaggtgcttgtgaaaagaatcatgaatgcaacaagggaggctggtcctgttgctgtcgccgattaagttttaaacttttatttattatttat

SEQ ID NO: 6736 - DNA, 555 bp, Homo sapiens
  misc_feature 495: n = A,T,C or G
ctcaggtagttgggctccaccctgtccccgcgcgctctgctccggcgaccggccctccctcctccccggttccccctggcccgcgccaggacccctgagaggaagccgggccgggccgcgctcgtgggtcggctggttgggatggcagctggacggcagcgcgcgtagtccacacgcgggtgggcatcacagggaaggcaggttccgggacgaggcgcccgctgtccggtggtccttcgagctctccgaggccgggcccgggggcggagggtagcgtccgccgctccagcgccgcgcagccaccgccgccgccgccgcctctccttagtcgccgccatgacgaccgcgtccacctcgcaggtgcgccagaactaccatcaggactcagaggccgccatcaaccgccagatcaacctggagctctacgcctcctacgtttacctgttcatgtcttactactttgaccgcgatgatgtggctgtgaagactttgcanatactttcttcacatctcatgaggagagggacatgctgagaactgatgaagtgcagacca

SEQ ID NO: 6737 - DNA, 648 bp, Homo sapiens
ccataattacaagtttattctcatacaatctctagcttctcaacagtggtgcctggcaaggggaggtgaagctgcatgcgggcggctccgggtgggcggctctggcacgtggtggttaccggctctgctcgatgtatgtggagatgtcgatttcctctggaagttctgccacattaacttcaaaccggtcctggacgtcattgaggattttggcatcattctcgtcagacacaaaagtgatggctaggcctttggtgccaaagcgacccgcccgggccacccggtgcaggtaggtgtccgagtcctcaggcatgtcgtagttaaagacgatgttgactcgctcgatgtccatcccccggccaaacagattggtggccaccaggatccgccgctggaaatccttgaactgctgatagcgtgacaggcgctcctcctgggccatgccccggtggatggcgatggccgggaagttctgctccacgaggagctgggccagggcatgcagcgctgcactgacttgacgaagattatcacctggttaaactccagcacatccaagagatcaaagagcttgcggttcttctcactgtctttgagtttgacgtagtactgctgcaggccgtgcagcgtgacgttggtctcgtcgtc

SEQ ID NO: 6738 - DNA, 487 bp, Homo sapiens
tcggcacgagggcaagtttcagaatttccttcttttttagggctgcatagtgttccattgtgtgtataaaccacattttgtttatccattcatccatagatggacacttggattgcttcaatttcttggctattgtgaataatattaatatgaacattggtgtgcaaatacctctttaagactctgatttcagttcttttgtgtgtatacccagaagtggaattgctgggtgatatggcaattttatttttaattttcgggggacctgccctactgttttccatagctgctgtgccacgttatgttcccaccagtattgcacaagggctccggctcaccgcattcttaccaacttgttatcttcagagttcgttcctttttttatttaatggcatccatcctgatgcgtatgagattgcacctcattgtggtacattattaatttttgttatgtaacaacatacattttataccttctgcaatattc

SEQ ID NO: 6739 - DNA, 562 bp, Homo sapiens
tcggcacgaggtgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttg

SEQ ID NO: 6740 - DNA, 533 bp, Homo sapiens
ttcggcacgaggtttttttttaacataaaatagaaactaactttatttctctggaagaagcaggtactgaatgccggagcagcaacttcgccaacaggctggtgggaaaacatggaaccgcgtgggggaattgggtggaagaggaagcactgatgtccctccagggcggctgccccttggtctccttccagccctggggccttgggccctggtccccgccagaaaatggtctggcaccctttctccgcttcctgagccacctcaggctatttccaggcacaagatcctgaggccagccaagtcccattcaagtccatggtaaggccacaagtcacattctgcccgacaccccagctgctgccaggggccccctggaagaaggcccagtcctaggaggtcccaccgggtgccggtccgcctctccctgtggccaacacatcccgcctgcccaggtccagcctggtttcctcccagtctgtcacccagggcagggcctgggggtactactccacccacaggccccgcccaggacc

SEQ ID NO: 6741 - DNA, 285 bp, Homo sapiens
ggaataggagggccaaagggccctaacccccggccgggtcccggggccaaaacttgggggaatttgaaccggcccggttcaaaaaaaaaccttaaccgtcctccggccttggggcccgtcttaaggccccggggggtttaacttgttttttcaaccccttgtgttgggccaaggggtcccaaaggctccactcccctttggagggggctgggaaaccccggagggaacctggcttttggaaggggcgcccccaccgtgggggagggaaaacggggccttttaaaa

SEQ ID NO: 6742 - DNA, 403 bp, Homo sapiens
gaagctgaactggatatacctatgtcacagcatctgtgggccccaaacctgactatgcagatgtagaggggaggtggggcctgtggtggacgctgggtgggagatggtgtgtgcaacccccaaaggtgcctgccggggcacactgtggtggtgggatgcaggcaggtatgtacagggtccaggcatgttgcggtggtggggtatgggcaggtgtgtgcagggccctggaggtgcctgcaggggcacactggggtggtggggtgcagtcaggtgtgtgcagggccctggaggtgcctgcaggggcatgctggggtggtggggtgtgggcaggtgtgtgcagcgccctgaaggtgcctgcaggggcacgctggggtggtggggtgcgggcaggtgtgtgcagggc

SEQ ID NO: 6743 - DNA, 498 bp, Homo sapiens
cggcacgaggacctgctcttccagctggagctgagtcgcaccagtgagaccaacaccctgttccggagcaacttctggcctcaaagtccatggagtcttttctgaaggtggccgggatgcagtacctgcacggcgtcctgggccccatcatcaacaaggtgtttgaggagaagaagtacgtggagctggaccccaccaaagtggaagttaaggatgtagggtgctccgggctgcaccgcccgcagaccgatgccgatgtgctggagcataacgcgcatacgctgcgcgcccacctgggggccctgctgagcgcgctcaaccgctcggttcgcgcgtgccccgccgtggtgcgcgccaccttccgccagctcttccggcgcgtgcgcgagcgcttacccggcgcccagcacgagaatgtaccgttcatcgccgtcaccagcttcctgtgcctgcgcttcttctctcccgccatcatgtcgcccaagctcttccacctgc

SEQ ID NO: 6744 - DNA, 618 bp, Homo sapiens
  misc_feature 612: n = A,T,C or G
gcacgaggcatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctggttttgcttttgtgcttaggcaagtgcaaaatactctatggaaatcataattgtcatcttcttcatggtgttagggatatattgtcacatgatttcaatanatcctt

SEQ ID NO: 6745 - DNA, 580 bp, Homo sapiens
gtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgct

SEQ ID NO: 6746 - DNA, 527 bp, Homo sapiens
gttctgaggttgcttttattccaagaactctgtgagctccgcccagataccattggcgcctgcttgtgtccccaggggacctacacacaacagcaccagcaccatgagggcgctctcgacccacacaagccctggtccccgtcagtcaatgtgactgagtccgccattgaggccagtctggctggccccaagtggtccctctgagtccccaactccctggccagcaaggagtgaagctccatgccccttggtccacgcctctagagtctgagcatatcctgcagcctcgatctcaggaggcaacgcatgcagcccccctgcactcagaaagggggcttctccagtcgtggtcttcttctctgtccacaagtttccagatggtctaggtgcttgtggtccaggaggccaaactggctttgcagatgctgaattcgcaggtgctgcttctccaggtgccgctgctgctgggccaccttgtggaagagttgctggatcctgctgttctgagccttgagttgtgtctgcag

SEQ ID NO: 6747 - DNA, 651 bp, Homo sapiens
  misc_feature 470: n = A,T,C or G
tgggaaagcacttgtctcctttattgaacatctgcagggggcacctctgcactgaccaggcagccagagaagcaagcaggcaggtggtggggggcaggggagcatggggcaggaagacgcccaccctcatttccagtccttgaaaaattgcttgaagatgggactctcatggccctgaggcagaatctccacctgagtgttcggggcgtactgcatgcgcgagatgaagccctcggccacctgcagggctgcctgccgctccttctcattcgcttttcgccccttccagatatagatcttgccacagagcccgttgtccagcacaaagcagtcatcagatatcagcagttcaagggcaaatgggctggagtcagccaccttggtcaggttcatctgtccagtggcatcagagaccttatacagagctgcggcctgggcatttgccttgtcagctgtgaggtcttcctcanggttgccctccttcagagcaggcttggggcccaggacctggatcatctcagcaggctcctccccatcagtgacaatctccacctgggccttgccctgtcgctcactgtcccggatggccagggccaggtccctcgccttggtgcgttccaagatgttggactttccaacacaccaggcgaa

SEQ ID NO: 6748 - DNA, 109 bp, Homo sapiens
ccttgcatccttttcttgtgtaaagaatttatttgtgccaaattgcaggaaacatcaggcaccacaccgcatgaaaaatctctcacagctagaaattgaaagggccttg

SEQ ID NO: 6749 - DNA, 565 bp, Homo sapiens
ttcggcacgaggcaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagaggtatgaagatggatacagcatcactatggacactcgtattcacttatttgcctcttcactgctgtaaacatttgattgtggccac

SEQ ID NO: 6750 - DNA, 536 bp, Homo sapiens; identical to SEQ ID NO: 1949
  misc_feature 508: n = A,T,C or G

SEQ ID NO: 6751 - DNA, 484 bp, Homo sapiens
actcaggattaagaatctcactcaaaaccgctcaactacatggaaactgaacaacctgctcctgaatgactactgggtacataacgaaatgaaggcagaaataaagacgttctgttgaaaccaacaagaacaaagacacaacataccagtctggacaatttctaatgactgcctcgtcattagattgagaaacatactgaactgcagacaccctgccttacctcatccccaccacctgctccagcagacacacctcaagagtgcgtcacttgtcacacaaaggggactttcttctgaacagtcggggccctgtcactaccccccacctaccacacagcagcatctctatttccattcaggcccaactttaaaaaaaagaacccagatgagagatctggctgtggcacactgcgatctgggatatgttccatgaaggttcatgcgccacatacacaaaatgaatagctgatactcctccttcatc

SEQ ID NO: 6752 - DNA, 704 bp, Homo sapiens
  misc_feature 648: n = A,T,C or G
ggacattttcattcaagtatattaatgtagatattttaaagtgggttataagtttaacattgtctttaaaatagaagtcacagctatcttccagcctgtcttctctaggaacgctgttgacatgccagggctccgtctacactggaagcagctatacagctgtgaccacatcgagctttagccagtcacacttctggaactgtccgttcagtccatcccatttctggctaagctcctcacgtaggtgcgtaggttctggttaataaaattcactgttgtgtgaaagacatcacggagcaaggacggcgtgtgactggccaccttcttggccagcagcagggccagcaccagcatggtcttctccttctccatgtctctagggtaggcctgcagcagctgctccagggcagtggccaggtccctgttccggtcctcctccgaccggctggtgttcctgagctgcagggccaggccgttcaccaggcccggagggatgctacggtccatgctgtccccgacctgggcgaggtgcctggcaatattccggatgatgtcttcttgactttcagaatctgcctctattcttcccaagcgggagtggctgctgcgttgccatcagtctgcagctcatcgtagccctcccactgnggagccagcactggcagctcgtggccccatgcgtccagctctctgcggaagctgtg

SEQ ID NO: 6753 - DNA, 489 bp, Homo sapiens
atttttgaaccttttaatatacattacaaatattttagaccaatcacattttgttgtaacatatttacaaaacaaaaaatatattacaataaatatgatgaaacagtgaatctgatcaacaacaagctttgtcacaaccagttatttaaaaggaatgcaaagacctgttggtctgcatatattaagagttttgagataaataggggtccagaattataatgtatccggaaaagagatgtgggggaaaatctccaaatttaagtaagattctttctcattgtaattacataatgtttaatgatgttttaaactgtgaacattgatgaattatccaaacatgatacaaagctaatgtagttctatcatttcaaaatacgtgacatccacagaatatccttttaattgttatcattatatactgtagttcacacaatatctacaaatgtgaatgagaaagaaaaacaggtcacagcaacatgtctcacattc

SEQ ID NO: 6754 - DNA, 175 bp, Homo sapiens
ggtagaactggcatactgctttctcctgctcacaggtctctatggaccccgttcgtagtcgtcggatttcatcaatggaatctcctgcagtcaatccccgctccttctacaggtaacaggtcagcatggtgacaatgctgccaaagcctagagcacagtgcactccagtaggttg

SEQ ID NO: 6755 - DNA, 477 bp, Homo sapiens
tttcctggttcgtaaaactcatttattcaacaaagcagtacaagcctccccttcaatcaggacctgcctgcaggggtgggctacttcagtgtcttcagccaatgggagctagagggtttaatactttagtccacttcccttcatctctggccccatcgacaacatggggaaggggagtgagggcctggtagaagggtactaaggccccttatttcgttcgctggtagaactggaagactgctttctcctgctcataggtctcgatggagccgggtcgtagtcgtcggatttcagcaatggcatctcctgcagccaagccccgctccttcaccaggtaacaggccagcatggtgccagtgcggccaaagcccagagcacagtgcactcccacagcctctccccgtgcgttggcctcgtccacgatctgcacgaaacggtcgatctggtcgggggccggcgggcagaagtcggggatgc

SEQ ID NO: 6756 - DNA, 694 bp, Homo sapiens
tttcatcgtaaattagtttaattctgtacagacaaccacgggactgattacaaagtgcggggcaaacaccagggcccatgagcgccagcagcgtggcccaccacgtgccggggctccagaggccacgcccgaaacaccaaataaatcacagacgtgacaattgcgggaggagcatgaatcagctgttccttcgggaggagaaaaaggaaacaacaatcagaggctttggaatgctttctcttcatgtgcctggaacgctgggcgggcggtgacccggggctcggagccccaccctggccacacctgctgtcgcccacggggtcctcacggtggggacccaggtcccacgacggctcccaacctgtggagctgtgtgcgcagccaccaccactgcggcctcagaagaggggccgggagccctggttctcaaactccgaccaggcgtcattcagctccatgaagatcatcttggcgtgctgctcgtacggctgccccgcagccttgtcggggtgcacggccagcaccgcgcggcgatagtgcttcttcacttgctccggagccaccaggtcggccatgcccacgggcgtccagcggctctccccgtcccacagcactgtgtgcagcgtggacagcagggccccgatgttccgctccttgccctcatccagtccaggagcttcagcttgagtgggtc

SEQ ID NO: 6757 - DNA, 558 bp, Homo sapiens
ttcggcacgaggagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacct

SEQ ID NO: 6758 - DNA, 70 bp, Homo sapiens
gtgagctgcccagatggctatacctgctgccgtctacagtcgggggcctggggctgctgcccttttaccc

SEQ ID NO: 6759 - DNA, 601 bp, Homo sapiens; identical to SEQ ID NO: 1953
  misc_feature 230: n = A,T,C or G

SEQ ID NO: 6760 - DNA, 482 bp, Homo sapiens
ggactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttacc

SEQ ID NO: 6761 - DNA, 435 bp, Homo sapiens
agtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtc

SEQ ID NO: 6762 - DNA, 569 bp, Homo sapiens
  misc_feature 317, 453: n = A,T,C or G
tcggcacgaggctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaagtggtggcggaaaatccctgccagaaccaccactgcaaacacggcaaggtgtgcgagctggatganaacaacacccccatgtgcgtgtgccaggaccccaccagctgcccagcccccattggcgagtttgagaaggtgtgcagcaatgacaacaagaccttcgactcttcctgccacttctttgccacaaagtgcaccctgngaggcaccaagaagggccacaagctccacctggactacatcgggccttgcaaatacatccccccttgcctggactctgagctgaccgaattccccctgcgcatgcgggactggctc

SEQ ID NO: 6763 - DNA, 448 bp, Homo sapiens
tgcaggtcgacactagtggatccaaagaattcggcacgagctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggccgaggccgctgagctcgcggaggcaaggccgaggataaggagtggatgcccgtcaccaagttgggccgcttggacaaggacatgaagatcaagtccctggaggatatctatctcttctccctgcccgttaagg

SEQ ID NO: 6764 - DNA, 499 bp, Homo sapiens
ccaagctgcagatccaggcttttctgggatagtgaggccaccatggctctggagaagtctcttgtccggctccttctgcttgtcctgatacagctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtgg

SEQ ID NO: 6765 - DNA, 98 bp, Homo sapiens
gggcccatgcagaatgccaccaagtatggcaacatgacagaggaccatgtgatgcacctgctccagaatgctgaccccctgaaggtgtacccgccact

SEQ ID NO: 6766 - DNA, 656 bp, Homo sapiens
  misc_feature 597: n = A,T,C or G
gcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacatanaactggaaaagcctcaggagcaaccagtcagtgaaagatgctgttcctgctaatctccc

SEQ ID NO: 6767 - DNA, 386 bp, Homo sapiens; identical to SEQ ID NO: 1958

SEQ ID NO: 6768 - DNA, 734 bp, Homo sapiens; identical to SEQ ID NO: 1959
  misc_feature 300, 387, 628, 649, 673, 675: n = A,T,C or G

SEQ ID NO: 6769 - DNA, 670 bp, Homo sapiens
  misc_feature 501: n = A,T,C or G
agctctcttagaaattttattggtcctggagaaaggaaggcaaactctgcctcccgctcagagtccccccaaccctcactgtttcccgttgccattgatggggaggttcacgtactcaggggaggccaggaaggccttgagcttgggccgggcactgaggcgccccacatatgctgagagcagggggaacgcatccaggcagccaggggctaggacctcatggatcagcagcaagtccagcaggttgtagtcagcgaaggagatctggtctcccacaatgaaggtcttgcctccctggttctgggacagcagggtctcaaaaggcttcagttgcccgggcagtgccttcacatagtcatccttgcccgcctcatagttggtgtagatgagggagacgtatttgcagcggaggtcctccacgccgtcattcaccatgtccaccagggctgcctcctgctggtccttcccatagagcccaagggtgcggcccaggtgacgcangatggtattggactggtacagggtgaggtctccgtcctggaacttggggagctgcccgtataggcaggaggctttgagtgagcccttctgccacgtctccacggtcaccaccttcttctttcagctctggccctgatctgccagcaacatgcgcaaggccgcgcaacgg

SEQ ID NO: 6770 - DNA, 472 bp, Homo sapiens
tcactagtaatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcc

SEQ ID NO: 6771 - DNA, 60 bp, Homo sapiens
aaacatgaatgtttcgctcgacctggctgccttttgcttggcaatagcctccgctgttcc

SEQ ID NO: 6772 - DNA, 551 bp, Homo sapiens
gggaatgagcagttcatcaatgcagccaagacatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttctcactg

SEQ ID NO: 6773 - DNA, 476 bp, Homo sapiens; identical to SEQ ID NO: 1965
  misc_feature 85, 360, 396: n = A,T,C or G

SEQ ID NO: 6774 - DNA, 284 bp, Homo sapiens
tttgacagcagggccgctttatttggatagacactgcggagggaccgggggctctacgtgttcgcagggatggtgtcattaaccgagtccacatagtggtagaccttggagtagactccaggcctgtcctgccaggaacaccagtgggcccacgagacaactccttggagctgtccgtctgagatcacagggccatcaaagtcacgcgggcaggaatctttgccatcgcttaaggaagcccccactagaacagtgctgttggtaagctgtccgggggtagtagg

SEQ ID NO: 6775 - DNA, 409 bp, Homo sapiens; identical to SEQ ID NO: 1968

SEQ ID NO: 6776 - DNA, 62 bp, Homo sapiens
tggtcatttacaaccttaacttcaaggcagaactggaattaggttcaaaataaaccttgatc

SEQ ID NO: 6777 - DNA, 611 bp, Homo sapiens
acccctggggatttattaatcatgcggtttaattccaattaaatggactccttgggagaaaaggattggattgatgggggggttcccaatttaatccatggtacggcgaattaaagggcattcctaaatggtggttattcagttaaaattaattggcacctttgtggtaacacatgggaactcctggttttcacagtttttcccccaacttatcacagccccgacaatagttccatttgtggcatccatacagactaagggggcctcagagtctcccttacaggcatcgatgggaccatcatatgtacccgcgcattccattttcttttcatagaaacggatttcgtaaaacttagagcagttgcttattagttttacttcaccccactgcaagtgaaagactctttcgctatctatttctcgtccccagccagaaacgatgcatgtatcatagggttggatagggtatggagacaatgggacacaggcggggatggaacgaggcaagtcacaatctctttttggtgtccggctttttttccatttcattcaaggcggatgtccatttggggaagtggcctgccatgttggttttcttggaaaataaatct

SEQ ID NO: 6778 - DNA, 252 bp, Homo sapiens
cctatctgatcactcccagcgtatgcaacttatctaccatcttccctgccactccctccctgcactaactctgatacccattgcaagccactctcccataagatgccttccttaactggcttgggctctgacactccgcatcacgacacactccttcctcacattaacactgtcttcacccagagcaggttctgacacccataccatgctatgttagctctgtaccacctcccataccaaagatggtttacg

SEQ ID NO: 6779 - DNA, 619 bp, Homo sapiens
  misc_feature 347, 537, 582, 616: n = A,T,C or G
cggaacttggatcacatcagatcctctcgagctccagcaggagaggcccttcctcgcctggcagcccctgagcggctcagcagggcaccatggcaagatcccttctcctgcccctgcagatcctactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggnacaggagagctcagaggatcaaggcctcgaagtcattccgccaccccggctactccacacagacccatgttaatgacctcatgctcgtgaagctcaatagccaggccaggctgtcatccatggtgaagaaagtcaggctgcctcccgctgcgaaccccctggaaccacctgtactgtctccggctggggnataacaagagccagatgtgacttttcctctgacctcatgtgcgtngatgtaagtcatttccccaagaattgaagaaggnttt

SEQ ID NO: 6780 - DNA, 584 bp, Homo sapiens
  misc_feature 385: n = A,T,C or G
ttcggcacgatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctantctatctccgcttcctcaacctctcctacaaacccttgtgtcgagggctgactttcaatagatcgcagcgagggagctgctctgctacgtacgaaaccccgacccaaaagcaggtcgtctacgaatggtttagcgccaggttccccacgaacgtgcggtgcgtgacgggcgaaggggcggccgcaagcttattcccttt

SEQ ID NO: 6781 - DNA, 532 bp, Homo sapiens
  misc_feature 322, 327, 328, 329, 499, 524: n = A,T,C or G
aatacctggagggcattatgagcgaggccccggggccattcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccancccannnccctgacaccccagcccccgccagtcacccctccccgcacacacccgtccataccagctccctgcccatgaccctcgctcaggggattcccctttgaggggtttagggtcccagttcccagtggaagaaacaggccaggagaagtgcgtgcgagctgaaggcagatgttnccacagtgaccccagagccctgggntataagtc

SEQ ID NO: 6782 - DNA, 507 bp, Homo sapiens
  misc_feature 286, 362, 507: n = A,T,C or G
gcgaccgctgtcctcaccacgcacgttccgccgccggatcgccttaatccaggaatgttccaggctctgggcaatggtcattctccgcttgggatctttgacgagcagccggcgaatgaagtccttggccagctcgctgtcgttgctgaagtactcctcgtcgaagtcgtagttcacggctgagatgttggtgagcgtctcctgcttggtctcgcccaggaacggggatgcaccgctcaggaggatataggtgatgacaccgatgctccacatgtctgcctccagnccaagcggctcatagttcacaatctctggggccacaaactccggggtgccgaagatgttcttgaactcgttccccngcctcgatcttgtgcgcgatgccgaagtcgatgagcttgattcgtgggttgggcacgttcttgtccagcagcatgatgttttccggcttcaggtcaaagtgtgcgatgcgcttagagtgcaggtaatgaacgccgtccaagaatn

SEQ ID NO: 6783 - DNA, 378 bp, Homo sapiens
gggagcgaccgcgctttttttttttttttttgcccttggttttggaaaaaaccactttttgttttgtgccccaggcgggcctaaaatcccgggcctccggcgtaaccccccaaaaatacgggaatggcaccttttgaaccccccgccctcagttgtttttttaaaaaaaagaaaaaagggggtttttttttgccccccaggctgaaatgcaggggccccatccgggttaattgaaccctaaacctccaaggttaatgcaaccctcccacctaaccctttaaagcagcgggaactacgggggggcatccccacacccacccaatttttttttttttttaaaaaagggttttggtgggcccccccggggggaaaaaaggg

SEQ ID NO: 6784 - DNA, 587 bp, Homo sapiens
  misc_feature 374: n = A,T,C or G
cggcacgaggccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttaaagctcaacccaaacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccangcagaagctgctctaggacctgggcctctcagaggctcttctgccatcccttgtctccctgaggccatcatcaaacaggacagagttggaagaagagactgggaggcagcaagaagggtcacataccagctcaggggagaatggagtactgtctcagtttctaaccactctgtgcaagtaagcatcttacaactggctcttcctcccctcact

SEQ ID NO: 6785 - DNA, 97 bp, Homo sapiens
tgcccacctttggctgatacccagagaacctgggcacttgctgcctgatgcccacccctgccagtcattgctccattcaaccaccgggaggtgggat

SEQ ID NO: 6786 - DNA, 466 bp, Homo sapiens
  misc_feature 24, 30, 32, 91, 299, 461: n = A,T,C or G
gaaatataaagatggaattgcttngctgangnacgcactggctaatcagagtgactgtgtcctgcatcggatcctaggagatttccttgtngctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtggntgaccaggagcagtggttcggcatgcagtgagggggcggcactccattggccgcagtggcctgccctgctctgagcacttccgtggactgaaggaaccgtaggagcctgctctcagaaggacaatgatttccagcatgtgaattgcagccaggggtctctgnccccc

SEQ ID NO: 6787 - DNA, 494 bp, Homo sapiens
cggcacgagggctcccaggaccagtccagtcctctagtgccttatctgaggctgcagccgccagtctccaccccaaggagacagcccctgctcctatatgcccttggcctccgcagtgcagcccccaggtgtcctgactgaagcacaggccatagccccatttccccggtgcctgcagggctaacctccacgggagcccacgagctctggccggcaagtccatggcacagggcatcggaagactgcaaaactgctggacttaccctgggctgcagtccattgtcggcccctgggttgaatcaagatagtacttgcagctagatggatgcttttaaccaggggacattgtgaggggaagattcctccacccagtctggcctgtggtgtctgtctcctccctgagaccacagcttctccagtagcagactcatgggcgccaccaagtggaatcacctggagcggcctctgccatccagtggggaagccaggccccg

SEQ ID NO: 6788 - DNA, 501 bp, Homo sapiens
  misc_feature 314, 351: n = A,T,C or G
cggcacgagggtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctantgcccgtggccggggattcaaagccgccgttccccangtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcac

SEQ ID NO: 6789 - DNA, 617 bp, Homo sapiens
  misc_feature 63, 150: n = A,T,C or G
tcggcacgaggacttctggatcgttctccttcaggtcagcaaaaagaaaaccttaccatgtgngaaagcagcacattgtctaatagaaaccaagccggcaaaagtactgctttgcagtctcaccacagatctaacagcaaggacatccanaacctgagtgtaggcctgccccgggctgacgaaggtctccctgccaatgaaagcttcctaaatggaaaccttgctggagctagtcttaatccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctga

SEQ ID NO: 6790 - DNA, 519 bp, Homo sapiens
  misc_feature 201: n = A,T,C or G
tcggcacgagggcaggcaccggtggccgagctccgtgaccatgaaggtcaaggtcatccccgtgctcgaggacgcgctgtcggtggccggctgcggctcgtgcctggagggcagcgcccagcagatgtaccagagcctggccgagctgggtaccctgccccccgagacgaaggtgttctgcggccacgagcacacgcttancaacctggagtttgcccagaaagtggagccctgcaacgaccacgtgagagccaagctgtcctgggctaagaagagggatgaggatgacgtgcccactgtgcaggcgactctgggcgaggagcgcctctacaaccccttcctgcgggtggcagaagagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactg

SEQ ID NO: 6791 - DNA, 572 bp, Homo sapiens
  misc_feature 137, 517: n = A,T,C or G
tcggcacgaggcgcctctccagtcccagccagaggggaccctggcctttggtgaccactgagaaggacacttcacgggcccagagctcctggtactgcccttcctttgagggccgtggagggctgtggacagcccancaacctgtcgctcttggaggctggtgtggccttgaggagggaagcctcgcatggccgctggaagaaaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcangtctgcaggctcctgcgggctcaccaggctgctggctccggtaccatgtaaacct

SEQ ID NO: 6792 - DNA, 625 bp, Homo sapiens
  misc_feature 549, 571, 587: n = A,T,C or G
ctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatccccattttcagtagcttaaaggaagccccccactttntttttttctgcctgagattctntaaggagatagacggnttgaaagacatcaatgaaacagaaggggcgttcttgaa

SEQ ID NO: 6793 - DNA, 487 bp, Homo sapiens
  misc_feature 156, 158, 384, 434, 479: n = A,T,C or G
agctgagtcaacaagctttattgtcatcaggcaaggaagcatggggaagggactgaagcagggggctgaggctggagaggccggagactgtggggcagatggggcggctgctccctgcctcctgggtggccggccggggtagctgagtcctcagcngngtggtctggtggacctgctcgcgggaggagatgaccttgccatcctggacctcttccacaatggtacgcacctgacgggtggtcaccggttctttcttgtactgagtcaggtgggcatcctctccctccagcaggcggcggtaggtggcaatctcctgctccagccgcgtcttcacatccagcaggattttgtattcctggttctgctgctccatctcgcagcganggggcccaagctgctcctccacgctgccaatcagcccctggatctggganagctgcacgcataacggtttctctgtctccgcagttggcctccangaatgctt

SEQ ID NO: 6794 - DNA, 535 bp, Homo sapiens
tcggcacgaggcagaaatcagctctattgacgaattctgccgcaagttccgcctggactgcccgctggccatggagcggatcaaggaggaccggcccatcaccatcaaggacgacaagggcaacctcaaccgctgcatcgcggacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggtgggtgtccctcccagccaggcagagccccgcagtgcccgagaccctcccagccaggcggagccccgcagtgcccctgaggccctcagcccccacatgccctgtgctgcactcccaggctgcagaccctgagcggcatgtcggcgtcagatgagctggacgactcacaggtgcgtcagatgctgttcgacctggagtcagcctacaacgccttcaaccgcttcctgcatgcctg

SEQ ID NO: 6795 - DNA, 537 bp, Homo sapiens
  misc_feature 219, 444, 465: n = A,T,C or G
cggcacgaggggacatgtttgtggtgtgatgcacacttttgcaagcgtgtaagatgttacctggtttgtctcttttggaaaacaaaaatcataaggctgcattctacagggcagagaaattcccccgaagactgagctggttgcctgcatcctctatcttctttgacccttatgactgaaagatcatcagtttggaaggtactggtccaatttatttangaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccanggtcctcatgtccttccttanagcctgagtggtgtgaggtgacaggtctctctctccactgcccctttctggtttaaaaaaatggtgcttgat

SEQ ID NO: 6796 - DNA, 490 bp, Homo sapiens
tcggcacgaggtgcgttccctgtgcgccggaagtgatcccctgcgtggctgggctgctcgggttacatcgtcaggaaaagcctaaagattacactgtgagaaaagaaaatagaagccatgtttcgaagacctgtattacatgtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgaaatgtggcgatcatgggatagtgaactttaccaactgggtgatgtcagtcaaaagacaacatggcacacaatatcattattccggccaagcctcacagacgtggcatatcaatatgtgaaaaaggggtctcgaatttatttggaagggataatatactatggtgaatacatggataaaaataatg

SEQ ID NO: 6797 - DNA, 338 bp, Homo sapiens
atcgtttttatgggaacctgcagggtgacccggcaccttgctaactgggcttagagtctaagggcttgggggctgcatctgatacaggttggagtttggggtgggagagtcctaggaagggggccccaagtagaaatgagagaaatcaggaagggatatcgggggcgtccacgggggtgctccgactggccttgcacccgtaccccagctctgcaccccccgtcacgagcagttcaatgcccgtgcagaagttggcttcggaggccagggaacactgccgcagccccgacctcagcgggctggcccatgcggcccagtggctggccagcattgccctc

SEQ ID NO: 6798 - DNA, 534 bp, Homo sapiens; identical to SEQ ID NO: 1981
  misc_feature 379: n = A,T,C or G

SEQ ID NO: 6799 - DNA, 567 bp, Homo sapiens
  misc_feature 491: n = A,T,C or G
ccccggaccagtgcagactccagccagaccctgccgtccatggttcatctcatccatgagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacaaanccgggagctgctgcgctgtctggaggaagaagtccggcatttgccccacattctgttgggcacgctgctgcggcac

SEQ ID NO: 6800 - DNA, 636 bp, Homo sapiens
acgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgattgaatacaggccctggacccttccctcaagtctcaccagttctgctctcccatcaagcttcagatgccatgttgtactgggggaatgtagcccttgtgctccccaccccctacctccacgccgagccctatgcagtctcaaaa

SEQ ID NO: 6801 - DNA, 541 bp, Homo sapiens; identical to SEQ ID NO: 1983

SEQ ID NO: 6802 - DNA, 683 bp, Homo sapiens
tcagccatagacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttaagactaaggaatgttccttcagggaaactagggtggggtttgaatgagatgaggggggcaggcatggcctgtagtccctactcagcgccccccaccctccacctctgcccttcagcaggttggggcagccagaacccttccattccagaactgccagagactgggacgctggggaaggtaagggcgcaagccagcagcgggagattgaactggggccacctgagctcccgaggccccgtggggagggcgggtggggaggagaaggccttggctgcctgaagctggaggcctcagcaaaggagagaggtggccaggcccatgctccaccccggcctgggctgccaaggtccgggctgggcacagtgttcattttctaacagtctggcgggagaggggcaggcaggaggcaggtccaggccccagggtgcagagatgtctgtctgggctaggggcctccagcactccgggctgaagagtgctgtctcctggaaatg

SEQ ID NO: 6803 - DNA, 541 bp, Homo sapiens
  misc_feature 188, 198: n = A,T,C or G
tcggcacgagcccttcactcctactgggaggtgggacccctttcattttcagttttgctcattctagggaaaataaggctttggtttccagtttaattgtttttgaccttctaaaatgtttttatgttagcactgatagttggcattactgttgttaagcactgtgttccagaccgtgtctgacttantgtaacctangagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgtt

SEQ ID NO: 6804 - DNA, 266 bp, Homo sapiens
ctacaaacaaaatgtccaaaccttcacatttttgggcagggcatttaagggcacctgcctttattttccccgttaaatgggcaatttaaaccttttgttaaccccagggctgcctgaaacattagggcccaacacctttcttgccacctttgccccaaaaccccgcaaagggctgggaaaccctggggggggaaacctggaaaacccctggcatttttacaaaatttttcctcctgccggaaattccttccttccacccattcaaa

SEQ ID NO: 6805 - DNA, 496 bp, Homo sapiens
  misc_feature 360, 385: n = A,T,C or G
tcggcacgaggcaggagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccanaaggggtggcgaaggcacagctcanagacataaagagaagatgccaaggctccctcctccacccaccgctaactctcagccccagtcaccctcttggagcttccctgctttgaattaaagaccactcatgctcttc

SEQ ID NO: 6806 - DNA, 489 bp, Homo sapiens
  misc_feature 105, 239, 389: n = A,T,C or G
tcggcacgagggatccggaccctgagactcccctaaggccagaaggtgcgcttctccgagaaggtcactgtccatttcctggctgtctgggcagggccggcccangccgcccgccagggcccctgggagcagcttgctcgggatcgcagccgcttcgcacgccgcatcacccaggcccaggaggagctgagcccctgcctcacccctgctgcccgggccagagcctgggcacgcctcangaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcantgggaggcgtggctgaaaccaactggtttgcctataatttattaactatttattttttctaagtgtgggtttatataaggaataaagccttttgatttgt

SEQ ID NO: 6807 - DNA, 508 bp, Homo sapiens
  misc_feature 16: n = A,T,C or G
gagcttctggtgatgnaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaggaactgccaggcaggaggccccctgaagtctgtgtactcctttttgg

SEQ ID NO: 6808 - DNA, 486 bp, Homo sapiens; identical to SEQ ID NO: 1984

SEQ ID NO: 6809 - DNA, 686 bp, Homo sapiens
tgcgtgtcggtctgcttttattacctcccagactgagcccccgacctggcccagcctggcccgtccccaatccagtgggctggccaggccacctgcaccagggaggacagctgctggcagggactaataaacccttccacctggccatggtggtggtgttctctatggaccgaggccctgaaacgcgggcagggaggggcagagaacacactagcttgggggtgggcaccagctcagacccctcagcagctttgggccctcggcgactttcccaggcagtgcaggctagcccagtccaggagtgtgcagcctggcttgggtcgagctctgtcacatctggataagcaactgggggctgagagtcccagggcagcctggcccagcaggtcaaggcgccacagggggccatcaggtccagctggcgcaggcggcaggaggagggtctgctctgacctgggtgctgcatgggtccctccagctgccaccacctgcaccaggcagtcccgaggggtcacaggctagcccagcacactgtcattgaagggcaggcagacaacagccttctggtggccgccatactctctcttgatctctccagtcttcacacaccagagacgggccaggttgttcgaggaagcagtgacgatgttactgggagtccccccagaaagggcacgccacatcca

SEQ ID NO: 6810 - DNA, 631 bp, Homo sapiens
  misc_feature 499, 535, 557, 613, 628: n = A,T,C or G
tttcctgtgaaaccaccatagagaatttatttttttctcaggtgaagtcagtaactaattcttcctattcccgttggacacaaggagtctgtgagggggtgtgaaggaaggaggctgcggctgcgtcctggactccgtcctgcggtagggagtccagcagggatggctcagcctccgcacctggtgtgcagccggatctccatcctgaggaaggccttgaggttctcatcagccacgtgctcctccagggcagccagggcccgctccccaccgtcctggaagtgctgcagcagcctgtccgcgtactccacccacacgcagttggggcagccactcatgcagcagtttgtgggcggctggagctcaggtggcagcgatgcctttgggcggcctggtgcgtccgcacctgcttgggagcccacctctacgtggtctgtcccgaattttctgcgcccatcaggggcttgcgctccgggatggtgcctttgaagaagctgcnacctccaggaagcctctggagcagtccgggctgganaaccggcgagccccaatttcantaattaactagtcctgcgaagggcatcatccggttcatgtcaaaggcaagtcccanagcccaggaggttgnaaa

SEQ ID NO: 6811 - DNA, 465 bp, Homo sapiens
  misc_feature 127: n = A,T,C or G
tcggcacgagaataattacaggccactcttgctctcaagtcccattgtaaaggaaaaatacctattaccctgtcttcattccacgtattgaaatgcttcttacaaagggatctaacatatttcttancaggggcccatggaaacacatttatttaatttttttattttttcaaaagcaatattactgctttgaaatctttcaaagtgaaggctgttatacagcttaataatggatctccttttacttgcctgaaattattctgaatcctgttaacatcatgccccgtattatccaaatagccatacagttaaatcaattttaaaacattgtaaaaggctgttttaacatcaatttttattttaattgaagcaacatacacatgtggtttagaaaaccaaattgtaaaaagacagcagctttgaatccctcctccccaccctgccccttccacacagtctgttact

SEQ ID NO: 6812 - DNA, 659 bp, Homo sapiens
  misc_feature 616: n = A,T,C or G
cggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcacatctgggctcggagaagagctcggtcatgaagaatgcaaggctgccaancccgagatgccctgttcttcacaataagccgaggattttggtg

SEQ ID NO: 6813 - DNA, 517 bp, Homo sapiens
tgcggccgcaggcttccccgcctggcgcctgccctccagcgtggggctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacaggtgaccccacccgcccaccgcc

SEQ ID NO: 6814 - DNA, 445 bp, Homo sapiens
ggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgcctcagttcctactcctcccacaagggacaggcgtccacccgccagaagaagagacaccgcgaagacattgaggattatatcagcctc

SEQ ID NO: 6815 - DNA, 571 bp, Homo sapiens
tttctgactcaaaaatcatactttattcttgagcccattggtcagggtagattcgcacactccctctgcagtgactccaggagcccctctcacagctcagagcggaacgtgaggctgcacctgccatcttctccgcatagtccgcatcgaagcgctcattctgcgccacggtgaaggtggtcttccagtccccagccatgcctttcctcatgaagggggagatgctgtggtccatgagctcctgggggacggtggtgtagttggtcatagggttcttcttcatctccttgaacgacgtgtgctgaaccatgaagtccatggtctcctctggcagggagcgccccacaaactccaggatcttttgaatctcccttttggggttctccttcatgtcttcatagaagaggtagagaacagggtgggtgcggctcagctcccaccactcctgcacgtgctggtaccaggacccgtaggacacttctccagccatgaacttttccaggaagctgtcccaggtcccaggctcagggtgcgccttttccatacggtggaaatggtagtaggagaccgc

SEQ ID NO: 6816 - DNA, 571 bp, Homo sapiens
  misc_feature 302, 464: n = A,T,C or G
tcggcacgaggagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagccctcgggaggctcagtcacactctccgagagcacagccatcatctcccatggtaccacaggcctggtcacatgggatgccaccctctaccttgcagaatgggccatcgagaacccagcagccttcactaacaggactgtcctanagcttggcagtggtgccggcctcacaggcctggccatctgcaagatgtaccgcccccgggcattcatcttcagtgactgtcacagccgggtcctcgagcagctccgagggaatgtccttctcaatggcctctcattagaggcagacatcactgccaacttanacagccccagggtgacagtggcccagctggactgggacgtagcgacggtccatcagctctctgccttccagccagatgttgtcattgcagcagacgtgctgtattgc

SEQ ID NO: 6817 - DNA, 58 bp, Homo sapiens
ggaggggcctagggagccgcaccttgtcatgtaccatcaataaagtaccctgtgctca

SEQ ID NO: 6818 - DNA, 520 bp, Homo sapiens
tcggcacgaggggcgtgttcacagcgccactggctggacgctacttgctgagcgcggtgctgactgggcaccggcacgagaaagtggaggccgtgctgtcccgctccaaccagggcgtggcccgcgtatactccggtggctacgatcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagatggggcacctatccctgggcgagcgccgcacccgggcccgcagcggcaccgcgcccatagcggcctctccccacgcccggggcgcgccggctc

SEQ ID NO: 6819 - DNA, 520 bp, Homo sapiens
tcggcacgaggcgggactgggtcagctctcagctggcagccacctgcaacgtggagccctcacttttcaccaactggttcagcgggcacctcaacttccatatcgagcaccacctcttccccaggatgccgagacacaactacagccgggtggccccgctggtcaagtcgctgtgtgccaagcacggcctcagctacgaagtgaagcccttcctcaccgcgctggtggacatcggcaggtccctgaagaagtctggtgacatctggctggacgcctacctccatcagtgaaggcaacacccaggcgggcagagaagggctcatggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacatttt

SEQ ID NO: 6820 - DNA, 527 bp, Homo sapiens; identical to SEQ ID NO: 1986

SEQ ID NO: 6821 - DNA, 568 bp, Homo sapiens
attcggcacgaggcgctgggggagccccctgggttcctgcactcctggtggtgcgtcttctgggacctgtactgcgcggcgcctgaccgaagagaggcctgcgagcactccggcgaggccaaggccttccaggactatagtgctgcagccgcccccagccccgttatggggagtatggccccaggtgacacaatggccgcaggctccatggcggctggcttcttccagggcccccccggctcccagccgtccccccacaaccccaacgcccccatgatggggcctcacggtcagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcaccggcccaggcctgcctgccatgaacatgggcc

SEQ ID NO: 6822 - DNA, 524 bp, Homo sapiens
  misc_feature 44: n = A,T,C or G
ttcggcacgaggccaaggctgtcctccccaaaacctggcctcanaacttctcatctcacttcaaccgtttccagcccttccacggcctctttgatggggtgcccaccactgcctacttctcaggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcatcaaccccgcggccaacgtctctgtggacgtggtgagggcgtgctcccggccgggcgtgggaaaggcggccctcctgccgcccttactgacgcgctgcctctgctcccctaagaaagtcttcatcgtgccggtggggaaccattccaacatccca

SEQ ID NO: 6823 - DNA, 546 bp, Homo sapiens
acatttcaaaaactaactttattgcatttaatacagatataagcacgaataagacaaattagttccattttcagacaggaagaaaaacattttgggtagggagaagttaattgctggtaaagtgtagtagtattattattctaaaagataatgagttcagaagtattaaggaaatatgtgtgtgtgtacgcataggtattcaggtaaacaccaataacaataaaactctataagcggtcacagacaacacaagtacaggaggaacatttaaatgttaaccaatgtcatgaaagaaagagtgatataagcaattctatacagcaaaaagagaatgaataacaatttaattgagttttatttatctacaaaaatatagcaatacagtgaacttcaccaaatcctaaatactcagtacctgaactggctacaacaccgtgtgcacacccagttcctgcagaatctcttgcagatatgggagagtcagccagtgaaaagatccatttcttgggaatccttgtcaacaagaccagttcagaaatccaggat

SEQ ID NO: 6824 - DNA, 541 bp, Homo sapiens
  misc_feature 383: n = A,T,C or G
tcggcacgaggcggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggngtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgt

SEQ ID NO: 6825 - DNA, 529 bp, Homo sapiens
  misc_feature 435, 451: n = A,T,C or G
tcggcacgaggaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcganaggctgcgtggctcangcccccaatgccatccttgaagtccatgtcctcttcctggagttcccaacgggcccgtcacagctggagctgactctc

SEQ ID NO: 6826 - DNA, 561 bp, Homo sapiens
cacagtcacaataggaagtgtatgattacatcactatctcgtttgtaagtttcttttcctaatcaacattatgattgtcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaagactatattttaattgctcttcttat

SEQ ID NO: 6827 - DNA, 565 bp, Homo sapiens; identical to SEQ ID NO: 1989

SEQ ID NO: 6828 - DNA, 490 bp, Homo sapiens
tattaaacctcaaattgggggtttgatttggaagacattagcaagtaatttggaataagttcccatccccaataacttggatcctgtagtccaagtaatagtcatggtctatcattcagttacttgtgctaggcacctgtgttagatattaggtataaatattaacagaaggcagggaagtgaaagcccccaggcatagccagtcatgttgccctggaacacaagaggtgtccaatctcctgcaggaagaggagctgctgccattctgggaacctcaagcttagttcagaggaaacatctatgaggagaaagcccaaccaccttcaacttaaaaaaacaaaagagttctgtggaccccctctgtagaaaaggaggggcatgtgattcaagaggccacctggatatttagttgaagtttatctttaaggctcgctgcttctcttgctgtcatttataagttcattcaataaatactgagcactttctatgt

SEQ ID NO: 6829 - DNA, 625 bp, Homo sapiens; identical to SEQ ID NO: 1990

SEQ ID NO: 6830 - DNA, 582 bp, Homo sapiens
attcggcacgaggactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatcttta

SEQ ID NO: 6831 - DNA, 403 bp, Homo sapiens; identical to SEQ ID NO: 1994

SEQ ID NO: 6832 - DNA, 591 bp, Homo sapiens; identical to SEQ ID NO: 1995
  misc_feature 470: n = A,T,C or G

SEQ ID NO: 6833 - DNA, 612 bp, Homo sapiens
ggagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggcccgctgcctgctggggctgtactttgctttcctgctcctgatcctcattgcccaggtgacggccggggccctcttctacttcaacatgggcaagctgaagcaggaaatgggcggcatcgtgactgagctcattcgagactacaacagcagtcgcgaggacagcctgcaggatgcctgggactacgtgcaggctc

SEQ ID NO: 6834 - DNA, 538 bp, Homo sapiens
gggccctactgctgcccctgtgcccctcgccccgccgggagtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgttagactcccctggacccccaaaaggagaaaaaggagaggaaagagaaaaggcaaagaagaaggaaaaagggcttgagtgttcagactggaagccagaagcaggcctttctccaccaaggaaaaaacgagaagaccccaaaaccaggagagactctgtggactccaagtcttctgcctcctcctctccaaaaagaccatcggtggaaagatcaaacagcagcaaatcaaaagcggagagccccaaacacct

SEQ ID NO: 6835 - DNA, 574 bp, Homo sapiens; identical to SEQ ID NO: 1999

SEQ ID NO: 6836 - DNA, 493 bp, Homo sapiens
ggtccaagtttttagtttcagagactaggcatatggttaatatttaggtaggaaattcaggaaaaggagcttgtagggcaggaagggaaggaacggcagcttggggcactctgacatctttaacaagtcttgtaaaggcttactaaatacaacgaagcattgtaccaactataccctaataaagattaaaaatttacattccagttaactaccttaaaagttaagtccactttcatcccacgcccccatcctttccgtcatccctcacccctttgtcttgagaaaggaggtttagctgcttctttagttctgcaatttctttttcttgctctattatcttcatctgtagggtgaggttaacatttccagaattttggaaaagttcactctgcagcagctgaatggcagatggtctctgcgatgagttccttctcgttaagtgctggatatacttggcttgcaccggacaccttttacggagggattccggaac

SEQ ID NO: 6837 - DNA, 553 bp, Homo sapiens
aacctttcccgtgaaggcatttattttcatcagtgtaaccaactactagcgttaaataacatataccatgctattaacaatggaataagtagaaggagctgaccatgggtgtattaacaaagaagctgacagcctggaaatatttacttgatgggtactgttggtgaccccgagcgatgaaaatgaacattctgccactttccatcccggcggtgcacacacgagtctcttctgactgcattgtctttggcattccactgccatccatgtactgtgtgagcctaatatatgctatgcaggcggcatcatcccctaccagatgtacatgagggtttagaataatagtgtggattggtttattgcttttggacaaagcattttcaaagtagaatcggtgaaaatccatcccttccactaaattacccaaagcttcaggttcaaaagcagtaaggcctgggtcacagatttttgtgtaggcttcaaagtccccattgttgatagcttcgatcagttgttcagtgactttgataatctcttgctttcgtgctttcac

SEQ ID NO: 6838 - DNA, 352 bp, Homo sapiens
  misc_feature 341: n = A,T,C or G
tgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaacataaataatgcccattttacaggtgacattttaaacaatgaaaaacaccaacggctctgactgacaactggggcattggtccataaaaaccctttctaaaaatngaaatatttgg

SEQ ID NO: 6839 - DNA, 618 bp, Homo sapiens
  misc_feature 479: n = A,T,C or G
tcggcacgagggacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccangagcccctggagttctcctaccccggctacctggccctgggcgaagcgcacctgagcatcatcgccaacgccgtcaatgagggcacctacacctgcgtggtgcgccgccagcagcgcgtgctgaccacctactcctggc

SEQ ID NO: 6840 - DNA, 530 bp, Homo sapiens
tggatcccccgggctgcaggaattcggcacgagggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccacccgggacccaaccctgcctccctgggctaggctctggcctgggcactcaccccctggcttaaacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctg

SEQ ID NO: 6841 - DNA, 536 bp, Homo sapiens
  misc_feature 109, 379: n = A,T,C or G
ttcggcacgaggagcagatggtgatttccctgacaccatccagtgtgcatacatccacctggtgtcccgtgaggagtgtgagcatgcctaccctggccagatcacccanaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctanaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccc

SEQ ID NO: 6842 - DNA, 489 bp, Homo sapiens
gaacagtgagggtgcagggagcaaggacgtcctggcctggcctccgattcgctggaattgcaaggaccctcccccagtaagggggctccctcaagggtgggaatagagtggaggcccgcacgggagttcttgtctgtgtgcaatccactttgtgggcgtgtgggtttaggtctggctgggccgtttctgaacttgacccctgaggactcatagtaccttaggggcggggctctccagtgggtggggcctcccgctctgagagcaaggcctcggggtctggaggacccggcttttccgggagggcgcggcctccgggggagacggcgagccgagcgggctgtcagccgaagagcttcaggaagcagggctggcagtagggcttgcggcgcgctcctggaaggaccccttggtgagcgggcgcaggcagaaggtgcatgtgaagtggtccgggtggaagcggcgacccagggccgacacgcagcggccggt

SEQ ID NO: 6843 - DNA, 507 bp, Homo sapiens
ggtaggaggtgcaggctgccaccatcacaggtgagagggcagaggctcacctgatggggacgaggcttgaggtgggctcaggctggcccccacatcacatccagcccgtggcgagtgtccttcaggaggtggctgtgccctcctggactcgaacatgtgtgagctgatgtaccacctaggagagcccagcctggctgccagcacctcatccaggacgacatgctctgtgctggctctgtccagggcaagaaagactcctgccagggtgactccggggggccgctggtctgccccatcaatgatacgtggatccaggccggcattgtgagctggggattcggctgtgccggcctttccggccatggtgtctacacccaggtgctaagctacacagactggattcagagaaccctggctgaatctcactcaggcatgtctggggcccgccaggtgcccaggatcccactcaggcacctccagatcccacccagtgctgctgcttgagct

SEQ ID NO: 6844 - DNA, 510 bp, Homo sapiens; identical to SEQ ID NO: 2009

SEQ ID NO: 6845 - DNA, 80 bp, Homo sapiens
tcggcacgagcccagatctcctggctttaacccctccttggccaaggccacggttgcctgcgggagccaggcgtccggtc

SEQ ID NO: 6846 - DNA, 523 bp, Homo sapiens
cggcacgagtgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcaaagacgaacgcccagcgctttggaaaccacatccgcaaagccctgctggacattgctgatcttttccaagttcccaaggcctacagctga

SEQ ID NO: 6847 - DNA, 500 bp, Homo sapiens
  misc_feature 321: n = A,T,C or G
tcggcacgaggccgggttctcggggtcctataggaccacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtangagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggac

SEQ ID NO: 6848 - DNA, 485 bp, Homo sapiens
  misc_feature 395, 444, 453: n = A,T,C or G
acagactcagagagaacccaccatggtgctgtctcctgccgacaagaccaacgtcaaggccgcctggggtaaggtcggcgcgcacgtggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggccaacgtggacgacatgcccaacgcgctgtccgccctgagcgacctgcacgcgcacaagcttcgggtggacccggtcaacttcaagctcctaagccactgcctgctggtgaccctgggccgcccaccttccccgccgagtttacccttgcggttgcaagncttccctgggacaagtttcctgggttttttgagcaaccttgttgaattncaaataacntttaagttggagctttggttggccatgttttt

SEQ ID NO: 6849 - DNA, 532 bp, Homo sapiens
ttcggcacgaggaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgaaggcattgcctacaggggcctctttatcatcgatggcaagggtgtccttcgccagatcactgttaatgatttgcctgtgggacgctccgtggat

SEQ ID NO: 6850 - DNA, 474 bp, Homo sapiens
  misc_feature 302: n = A,T,C or G
ttcggcacgaggctttattaatgaccagggtaacccgttcagctagggagctcctcaatgagagttcttggggcaggtggcacggggcctccccaaagccgctccagctccccagtgagggcggccacctcctcggctaccacagcatgggcttggtgagccctggcgcagtctaaagccaggggtgtgagggccgcctcattttcgttggtccaggccaggaggaactggcactttttccgggcccggtaaagatgatctcgctcttctctagccacggcctgtttccgggcacggcccanggtctgtgccaggtcccccagtgctgccagcgtgtagcctttctggttggtcgggccctcgcccagcaggatgcgggcgacctcgtgcatagcccctcgtgtgcccaggggccccggcgggtgctcgcctgcttccagcacgtgggctgccgcctgcagggcttcttccgca

SEQ ID NO: 6851 - DNA, 596 bp, Homo sapiens
tcggcacgaggaccgcatcgaaacgccgctgagacctcagccttgacctccctcagcgtggccgggaccctgagcctctgcgcagagccacccgccccgacgtacttaggcggcatagccctgagacctctggccagcgccaggcaggcagcgggggcggcagaagcctgggcctgagtcttctggctctgcctctccctggggacaggagggagcctgggggtgtgggtggggagccggccggccgtgacccagcgcctggctctgcccgcaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgc

SEQ ID NO: 6852 - DNA, 499 bp, Homo sapiens
tcggcacgagcattaatcttggccactgacatggcaagacatgcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagaaaataaaaccagctctcccatgaaggcacagccccagcatggcactctgaaagcccacctatgtgggggcaactccaacacagctcccgctcc

SEQ ID NO: 6853 - DNA, 463 bp, Homo sapiens
  misc_feature 38, 456: n = A,T,C or G
ggaatgtacatctaattgacactacattgcattaatcnatagctgcactttttgcaaactgtggctatgacagtcctgaacaagaagggtttcctgtttaagctgcagtaacttttctgactatggatcatcgttccttctgtggcagatttttacagttcctctaatgcatttgggacgactgtctcaaagtaacctgcagctttcctgacaactcctagctctctctcctgctaagaactgtagcccttttctgctgtttttagaaccttctgctaccatatccaccacttccaccaccagatccataaccaccaccatagggactgcccgagcttcttccaccaaaactgccccctttcatgggtccataatttgattgctgttgtcactataatttccaaaatcattatagttcccaccaccaccatagttaccacgccaaaattcctcctncattgta

SEQ ID NO: 6854 - DNA, 414 bp, Homo sapiens
aaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacaatgtgccccgtcacctccctgccctcccgtcatttgccctgggtctcccccaccaaaatgggagccaggagtcccagccaggcacaggaccgagcctggctctcggtcaacaggtgatgagctgggagcagctccttggccagaggcttacaggcaacaagcggccaggcagggtctggccccgggctgctgggctcacaaaggcacactagaccacagtgacgatctctgtaagcacaaagggactccgatgtgggtggggtga

SEQ ID NO: 6855 - DNA, 443 bp, Homo sapiens; identical to SEQ ID NO: 322

SEQ ID NO: 6856 - DNA, 563 bp, Homo sapiens; identical to SEQ ID NO: 2014
  misc_feature 134: n = A,T,C or G

SEQ ID NO: 6857 - DNA, 409 bp, Homo sapiens
  misc_feature 153: n = A,T,C or G
cccggcgctggcttttattgcctcctggagagaggaggtgtcccaggccaggccaggcaggagagggctggggcaggggagtttcagtctatgtggtggaggctcagatttggagctggaggggttggtggcggttcttagagctgagctttngggccagggtccctgggtctgggctgggagactcagtcagaaataggtattgcttatcctctgggactatgacagcccctccctggggttgggggtgtgacagggacagaagccgacccagggggtccctgagagcccaggggaaggaggatgcctgggactgcatctgcctcctgcggggcctggacagggagggggccagaccacagcggcccctcctccggtcattgtgcgggcctctgaggctgtggcaggt

SEQ ID NO: 6858 - DNA, 653 bp, Homo sapiens
  misc_feature 225, 544: n = A,T,C or G
tcggcatgaggacagacgcggcttctgcctccgcctgcataattagttgggacttctctgcctcggctaggcgctccagcttgtagcgctccgcttccgctggcttccgcacccgggcctccagctccttctcccgccgggcgatctcctgctcctgcactgccacctgctgggcccgctccaccacctgcacctgcacccgctgctcctcaatctgctgcttantcttggccacctgaagctgataggccaggtcagcctgtgctcggcgggtgttgacctcgatgtcataggcggccttcttcagttcgtaatctctctgtgccttggccatctcgatctcactcaggtactgagcagacaccttttcctgcttggctttagcttcccggatcccagcatctctcttggcctctgcttctccaatccgtgcatctttttggacttgagctgttcgagccttccccaaagagtgcaaatagtcctggtcatcgtgaatgtccttcagagtgtagctaaccacactgatgcccatgttgaccangtctgaggaggccactttgaaaacctgttctgagaatttctgcctgtccttatagatctcctccacagtcatgtgggccatgatggccctctggtggccctctaacgtc

SEQ ID NO: 6859 - DNA, 502 bp, Homo sapiens; identical to SEQ ID NO: 2017

SEQ ID NO: 6860 - DNA, 370 bp, Homo sapiens
tctccaccatggcctgggctctgctcctcctcaccctcctcactcagggcacaggatcctgggctcagtctgccctgactcagcctccctccgtgtccgggtctcctggacagtcagtcaccatctcctgcactggaacctccactgacattggttcttatagccgtgtctcctggtaccaccaggccccagccacagcccccaaactcatcatttatgaagtcagtaatcggccctcagggtccctgatcgcttctctgggtccaagtctggcaacacggcctccctgaccatctctgggctccaggctgaagacgaggctgattattactgcgcctcatatgcagccagcagcactgtaatattcggc

SEQ ID NO: 6861 - DNA, 567 bp, Homo sapiens
cggcacgaggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcct

SEQ ID NO: 6862 - DNA, 554 bp, Homo sapiens
  misc_feature 286, 423: n = A,T,C or G
cggcacgaggatcttcctgcaggcagctgggctggactccctccctggctacccttcccttcgtctctgatggtgacatccaaacaataaatatgcaataaatagcgctcctgggctgggccgggccggctgccttcaaaccccactcggcccctaccagtcttctctggccaggacaggcctactggggtgctagatagtaaagtccccaaacatcccagggtcccacaagacctgggatccatctccattttgaggcccaggcctggtttccaaggagacctancaaagctgggtccaggacagggccaggcaagcagggctggcaggtgggtgctgggaagaggctgttaccccagaccacagcttgttatgtcctggccaagacctcgactccaggccacaagatgacactgggctcangagtagatggtgatgacttcacggccaccaccgcgcaccaacagcacccgctcaaggccctcggtcagcacctcgaggaactccatgtagttctcgtcgccctcactgttcctgggtgggccaggcatgtt

SEQ ID NO: 6863 - DNA, 525 bp, Homo sapiens
  misc_feature 213, 350: n = A,T,C or G
cggcacgaggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttancctctctgcccttccactctctgaccaccgcccccgccctccccacccagctccgcttcttgttacttgggggaggaaagaaactcctgatcattggccaaagggacttacccctggagaggccaagtgccttctangaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtatt

SEQ ID NO: 6864 - DNA, 493 bp, Homo sapiens
  misc_feature 449: n = A,T,C or G
tcggcacgaggctcctgggccggggcccttaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctganggctaattctgggaagggagagttctttgctgcccctgtctgga

SEQ ID NO: 6865 - DNA, 108 bp, Homo sapiens
atatggatgccccccaccctaccacacattcgaaaaacccggatacataaaatctacacaaaaaaggaaggaatcgaaccccccaaagctggtttcaagccaacccca

SEQ ID NO: 6866 - DNA, 530 bp, Homo sapiens
tcggcacgagggttattaagaaaagtcatatttttgcatttcagccaaaataaagaccgcctgtaataatctgttagaaacagataatacatgtgctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctaacctgtgacttaatgttgatgctttgctttgtcttttggctggcctaacctacattgacatgtacacagaacattttaaaac

SEQ ID NO: 6867 - DNA, 578 bp, Homo sapiens
  misc_feature 131: n = A,T,C or G
tcggcacgaggtcgggctgctggttgcgggctcgcgcctgccgcggatcaaaagccagaccatcgcctgtcgctcgggacccacctggtggggaccgcagcggctgaactcgggtggccgctgggactcanaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaaggcgatgttcgggaacc

SEQ ID NO: 6868 - DNA, 603 bp, Homo sapiens
  misc_feature 516: n = A,T,C or G
tcggcacgagggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaagtgcctggacccanggtgtgccagcccgtctctgtgcagtccctggaaggggcgctgagaaaggcaccagctccttggaccccacctcccatgctctcact

SEQ ID NO: 6869 - DNA, 422 bp, Homo sapiens
cggttcccccaacatgttcccgttcactctgcccccacccccaaaggctcagcctctaaatctcagactccaccaccatcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacactaggcagcttcttcggcagcctcacggcagcaaccccagccttctcaaagcagcaggcgcctccaggctggtggccaacctagaaggcaggggtcaatctaacaaaaccctaacgttgacttttttccctggtggggcttcttctgtaacatgacttgcgaatatttatataaaa

SEQ ID NO: 6870 - DNA, 572 bp, Homo sapiens
tcggcacgaggagaagtttggagtccgctgacgtcgccgcccaaatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaagccgtgttgggggatgctttggtagatttctccctgaagctctaccacgccttctcagcaatgaagaaggtggagaccaacatggccttttccccattcagcatcgccagc

SEQ ID NO: 6871 - DNA, 468 bp, Homo sapiens
caggaggctgcagttcagctttattttcatgcccctcatgtccagttaaggctcaagatcagccccggccacagtcccccagcactgggactcagcttcccacctggacagggcagggggttctcttgccaactcctgccagcctccttcagctgggggatccccagagaccgctgcctcaacgggagccacctggaagaaccagaactccagcctggagctgctcgtgggggccagccatcccccctgtccacacactcgtcccagctccatctccgggccccggcgctgaccgtggaggatctcagggcccaggctccttgtccaaggctccccttggtccctggctcctgagtcttgggctgcctgggcagtgcggaagtggacaagcttgcaggagacacaggggaaagaaggaagctcctccccaagagctggtgggtcaaaagagttggggggctggtggta

SEQ ID NO: 6872 - DNA, 574 bp, Homo sapiens; identical to SEQ ID NO: 2025
  misc_feature 388: n = A,T,C or G

SEQ ID NO: 6873 - DNA, 539 bp, Homo sapiens
  misc_feature 119, 366: n = A,T,C or G
acttcagggctgtgaggaaggggtgcctggagttctgcaggacgcggttctcggtgagtgtgtgggccacctcgtccttggccacgatgacttccttcttgaggatcttcatggcgtantagcggcctgtggccttctccttcaccaggatcaccttgccgaaagtgcccttgcccagcagcttcaggtactcaaactcgttcatggtcacgcggtgcttgggcttggccagggacacctccatctcttcagcccctgagttgtcactgggtgagcccgaccggaagtccatctcctcctcctcctgcttcttgaggccgtcagccacagtctggatggcggttgtccactcctcccgctcctcangagtctccacatggaaggtgcgttcgatgacagtggtccactgcaggcagcggatgatgaaggtgttgggccggggccgctccgtcttcatcagctggcactgcgccacagagaagttgttgaggggagcctcacgttggtccacatcctgcggccgcaagcttattcccttt

SEQ ID NO: 6874 - DNA, 643 bp, Homo sapiens
ttcggcacgaggaccaatctgaagtaggaacggccgagggttgggggagaggcccttctctaggcagggcagactcctcggggatttaagtgctgaagtaaactatgatgatgatgaggatgatggcgcaaatcactcccaagatgatcatcatcttgaggtttttccaccagtatttgcgcttgagcttggctgcgcttgtttcaaactgggaggcccccgcctggagtgcatctgcacggtcgtccagctccgacagcttctggtctcgctccaggaccttgtccacgttcaccctcatgatgtccaccacctcatccacctgggcctgggtctgctgcagtctcctgttactggtgaggtttggagggggtgcagggggaccaccctccccagccggggcagcagggggggccgtggcagcggtagcagacctgtccatcctcgtccctccagtcctccttttcgggaggaaggccacccgatgtaagccctggtctcggtccagccctgccgccgatgagctgcgtgaccttgagcgaggccccccggcctcagtttccccgcctgtcaactgagggcgacctcacagatgcgatccgggtcgacccgaaagacaggcggccgcaagcttattcccttt

SEQ ID NO: 6875 - DNA, 638 bp, Homo sapiens
tatttattagtgaataaataaaagtttatcattccgtacaaacgcactcattttccacaacagtttttacacgagccgcggtggcccggtggtggcacgtggggagcggccccgcgacggacgttctcgcgggcggcgtcacagcggctccaggtcctcgtccccgcatgcgtactcgtacaggtccacggcgcccagcggtgaggagcgtcgaagaagggcctctgggcagcggggagcgcagcactcagcttctgctccacagggctgagctcggcctcgaacccgtcctcccagggctctcccgcggtctcctcggccaccaggatgtcgtactcctcggccgcgtacttctcccagtccgagagctcggggccgccgctgtcaccgtccctgagcagggagatctgctctttctgctcgtggtcgaggtacttctcgatgttgaagaaggtgtcgaagaagacgttggccagcttgcagcgcttcaggtcctgcagcgtgatcttcccttcagtcctcggcttgaccaggtccagcatctggcagaggcagtcctggaatggcagggcatcgatgggcatgctgttcagccttcggcactggctctcgtagaagtactcgagctcgatcatgga

SEQ ID NO: 6876 - DNA, 399 bp, Homo sapiens
ggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaa

SEQ ID NO: 6877 - DNA, 541 bp, Homo sapiens
  misc_feature 315, 363: n = A,T,C or G
ttcggcacgaggcccaggcagccagtgggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttcttangaccctcagatgatgggagctcatgctggaaaacacaacagcccctancaccttgtcaccactctggggctctgtggaagaaagggcacttaaaactcccagtaaatcttggaataaatatatttttccttcccttgtactttccatggtagctgaatgtgctcagatgtgagcagtcagagactgacagccatgctttcctatacttgttcaaaggatcgatgga

SEQ ID NO: 6878 - DNA, 532 bp, Homo sapiens
  misc_feature 463: n = A,T,C or G
cttctcttctgcttccatattacaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcnagaagaaccaggagcagtggcacgtggtgtccaggaagaagcagaagatcattaagatgctcctgattg

SEQ ID NO: 6879 - DNA, 83 bp, Homo sapiens
tggcggataatcttatagcagatgccttgttagattggaatcgcatttcaacccaaaggattccctttatcattccttgcaga

SEQ ID NO: 6880 - DNA, 614 bp, Homo sapiens
  misc_feature 486, 532: n = A,T,C or G
tcggcacgaggcagaacttcacagtgacactggaccaggtcctgctccgctgcctggaacaccagcagcactggaaccacctggacgaagagcaggccagcccggacctctggagtgcccccagcccaaagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactangtgccttttgtttttggctttcctggttctgtctaaactggcctangggccagggctttgggatgggaggccgggagaggatgtcttttttaaggctctgtgccttggtctctccttcctcttggctg

SEQ ID NO: 6881 - DNA, 400 bp, Homo sapiens
gctcggaaggtgcgtggatgcccttgctgtcctggggtggccctgtgggagccggatgaggttgttggacaagttcaggtagatgagtctcgggagcgcggccaggtcggggaaatggagcagtttgttctcccgcaggtcaagccaggtgagctggaactcagcctggggtgggtaggccgtctgaaaggcctcgatgctgttgcagctcaggtctagcacccgcagctgctggaggctgaagtcggagatgcaggtgagggaattcctggagaggttgagatgggtcaggcggggcaggccctcgaaggcgccatcctcgatgtccatcagcacgttgctatgcaggtcaagctgctccagcgcaggcatgtcccggaaggtgtggcgggtgagggag

SEQ ID NO: 6882 - DNA, 56 bp, Homo sapiens
tacctttagtgggccctttatgtggtcatcctgaacttccactgttgaagaatcat

SEQ ID NO: 6883 - DNA, 515 bp, Homo sapiens; identical to SEQ ID NO: 2026

SEQ ID NO: 6884 - DNA, 467 bp, Homo sapiens
  misc_feature 429, 431: n = A,T,C or G
taaatagtggcaactggtatttattacaattatatacagtcctatcttccgttctgaggtctatacatgatcacacaaatgaacatgtgtttcctggggggaaggacagagctggctgttggtcaggaaggccctgctgcctggctcctcctccgggtgagccccatctcgccatgggattagctgaaccattacacggcaagcgggggcatcggaagcgcagtaggtttcatttgtctgggaggacgacggggcatgagtggggttggggctggggacaggcacctgacgggtccagggccgggccacgggagggagggggatgctagctctggccatgcgtggtgtcacggtagtcaagacactcagcaaacacaccctgggcaaggcgtctgtccgggagagggggctggggaggggcttgggcgngngcttcgctgccttcagcctgacttgagatcaaagcc

SEQ ID NO: 6885 - DNA, 601 bp, Homo sapiens
tcggcacgagggtgaaaaggcagaagaattaaaggacattgtgcctgaaaagaaagcctttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctcc

SEQ ID NO: 6886 - DNA, 460 bp, Homo sapiens; identical to SEQ ID NO: 2030
  misc_feature 385: n = A,T,C or G

SEQ ID NO: 6887 - DNA, 600 bp, Homo sapiens
  misc_feature 80, 563: n = A,T,C or G
tcggcacgaggtaaactcatcgccaccacccactgctgcatcaaccctctcctatatgcgtttcttgatgggacatttancaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaagcaccgtgcaaggctctttacaaacgtgagctccttcgcctcctaccacttgtccatagtgtggataggactagtctcatttctctgagaagaaaactaaggcgcggaaatttgtctaagatcacataactgaggaagtggcagaactgattctccagccctggtagcatttgctcagagcctacgcttggtccagaacatcaaactccaaaccctgnggacaaacgacatgaaataaatgtattttaaaacatc

SEQ ID NO: 6888 - DNA, 619 bp, Homo sapiens
tcggcacgaggctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactg

SEQ ID NO: 6889 - DNA, 622 bp, Homo sapiens
gtttctgggggcagtgtgagctttgagggttggaatattgggaagcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttattttgagctcgtatttacccctgctgataagtgacttgagagttcccggttttttcctcttgtccttccctcccttctgtccttccatgtgtgggg

SEQ ID NO: 6890 - DNA, 97 bp, Homo sapiens
gctgctaaaggacgacagaagggtactgctgcaagaagacgacgcaagggtaccgctgctagaagactacagaacggtacggctgctagaagactac

SEQ ID NO: 6891 - DNA, 319 bp, Homo sapiens
gggatgtttccaaatttacttgattttcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaa

SEQ ID NO: 6892 - DNA, 160 bp, Homo sapiens
gtgaccttgagtgatgttatttctcagtacgcatatgtgcttattaaggtttctgcttatagcagcctgatagtattccatcatgctaactctctgactatattctactctaagctcaccttactgattgattgcctcacgcagagagtaaatacttact

SEQ ID NO: 6893 - DNA, 550 bp, Homo sapiens
  misc_feature 468: n = A,T,C or G
acagaaggggatatgggttagggattctccatggactccagaaaccctaaatacaattttgaggttttccaataataccatagcagaaatgtccaaggggttgggggaagatattaccttgagaaaacagaaatgtaaaggatttttgaccttatatatgtgtgtggttttgtttttgtttttgttcttgagagagtctcactctgtcacccaggctggagtgcagtggcgtgacctctgctcgctgtaacctctgcctcctgggttcaggtgattcttctgcctcagcctcccaactagctgggactacaggtacaccacacccagctcatttttttgtatttttagtagagacaggagtttgagaccagcctggccagcatggtgaaaccccgtctctactaaaaatgcaaaaattagctaggcgtggtggtgcatgcctgtaatcccagctacttgggaggctgnagcaggagaattgcctgaactcatgaagcggaggttgcagtgagccgagattgcgccactgcagtctagtctgggtgacata

SEQ ID NO: 6894 - DNA, 631 bp, Homo sapiens
acatttatatttaattaaacatgaggtccatttagattttgggttgattcattcatctgtgattactgagcatttgccatgtgccagtcaatcagtattaggcaccagagttaccacagtgagcaagagagacatggaccccttctgcaagatgcctagacaattaaatggccaatgaaactaaagtgaggtaagggttctgatgtgaaaagctgagggtgtgatgaggacaagtggcagaaagttcacctggcttggtggaagggaaggtcagagaagacctcttagaggactcagtaatgtccattgaggattttaggttgaagggaatgtttgaagtttgagggcccttttgaggaccaccaagaacttcactgtgctgtaggatattgagcaggaggtgaagctagagagatgtgtaggccacattgcagagtttgaacttggggcaatgggaagccattgaagggttttaaacaacccaagtggtgcattcttctgtaaatgttagagagatcagtggctgccctgcacatcaaaggggagaacgattggagacaggcagattagatggaaggacggagttgtactccaagccaaagatgatggagagtgaattaagttagtgcaa

SEQ ID NO: 6895 - DNA, 443 bp, Homo sapiens
gacagaaggggctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgt

SEQ ID NO: 6896 - DNA, 415 bp, Homo sapiens; identical to SEQ ID NO: 2036

SEQ ID NO: 6897 - DNA, 463 bp, Homo sapiens
gtaaactcaagtgggaagagctttgaatttgtagtttcagctgacataagcctaaaattcagctctacacacagcatcatggccacattaaattgcttaacctttttgattttaattttccttacatataaaacatggaaataatagctaatatataaggccatcagttaactgaatgcttgccatgtgccaggcaccactttaaaataacatctgattttcctcatttcagtgataaggaaccagaggctgggattacaggcatgagccactgcacccagcctgttctttttattcttaaatgcatccaggaacacgctcccaggcactatgcccagcgacttcttgccagcattttattacaggccacttctgacttataaccaaattgattcctggatcaaagcctttgcaagccaaccacagttgaatctttatttcctgtcagcacaatttccacatt

SEQ ID NO: 6898 - DNA, 479 bp, Homo sapiens
tatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttag

SEQ ID NO: 6899 - DNA, 184 bp, Homo sapiens
ggactcctccctggctggggagactgcttgtgtggaacaggctggggaggaagaggataatcaacatttgctgcttcctaacgtgtgtgccaggcattgcactaaatgctttacattggcaaggcacagtggctcacgcctgtaattccagcactttgggaggccgaggtgggtggatcacctg

SEQ ID NO: 6900 - DNA, 413 bp, Homo sapiens
cattttttattaacagcatcggtagcagaatggtgtccagccagtagcagctcctctcccctggtgtcacaaacctcactgcagagtcgtgcccatcaaaatgggcactccaaggagtgttgtatgtgaaatggaatatccacagactagcatgtcttttttttttttattataatactttaagttttagggtacgtgtgcacattgggcaggttagttacatatgtatacatgtgccatgctggtgcgctgcacccactaaactagcatgtcaaaagggagtggctgggattatagacaacctggacccagggtaccgaaagttttactttttaaaattgggaatgtttgatgttaaagttttaggggtcagtaaatggcaaagccctgttacctgaccaggttcaaaatca

SEQ ID NO: 6901 - DNA, 472 bp, Homo sapiens
ggctgagtcccaggccctctctatggccacggctagcctccagatgggcaatggtgccccagctgggccacagccagggagcgaggcaggtgccgggagagccctcagtgacaggcggcagaacaaaggccacccagcacctgctgcctaggtagccctcaaccacctcagctgaacctgtgcattacccacaggcagccaggctcccgagtgggggcagggactcgcttcccaagtagcacctggctggggacacgggaagtgaggtcagcagtgcgcaggcagctgagtggctctttctcaagggaacacgagtagcagactcagaggggccaggaccattgagagggaaggcataggggatagaagttcacttcactgcatgtgttcacatgcctggcaatgtgctacgcacttttcatacaacattctcaatctcatcttcacaaacctctttgggcatctgtattaa

SEQ ID NO: 6902 - DNA, 493 bp, Homo sapiens
gggaaagtaggcagggctgtgttcctttgtgtagtctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaacc

SEQ ID NO: 6903 - DNA, 51 bp, Homo sapiens
attgaagtcacttttgacattgatgccaatggtatcctcaatgtctctgct

SEQ ID NO: 6904 - DNA, 446 bp, Homo sapiens
gggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaaattttcctctttttataatccatgaaattcgaaaacagaaaattattcaaagaataggcaaatgtcatgacagaacttagtgtgagcaagtcattgagaattaaaatctaacttttcaggtcagagagccttgaaatacttacaataaagttataaaggcctaggtatttttctttcttttttttttt

SEQ ID NO: 6905 - DNA, 604 bp, Homo sapiens
acagaaggggtcaaactatacagctgtctgtcctacagttttttattatggtgtagctgtatttaaatacaaagagggccaggtgcagtggctcacacctgtaatcccagcagtttaggaggccaaggcaggggatcacttgaggtcaggagttcaagaccaccttggccaacatgatgaaaccccatctctactaaaaatacaaaaattagctgggcatgatggcacaagcctgttatcccagctacttgggaggctgagacaggagaatcacttgaaccctggaggtggaggttgcagtgagccgagattttgccattgcactctagcctggacaacagagcgagacttcatctcaaaataaataagtaaataataaaaataaaaagagatctaattgcatctgtcttttaaaattgacttatcttttaagttatttgacatgttttatagtttttataaaagtcgtaggaataggaaaaggatttacatatatcccttttcgcatctgaaagctgactaaataaccagtattacaggctggtcatagtggctcacgcctataatcccagcactttgggaggctgaggtgggcggatcacct

SEQ ID NO: 6906 - DNA, 590 bp, Homo sapiens
  misc_feature 541: n = A,T,C or G
acagaagggagttaaaaacatgccattttcatttctaacattttaagtatatggtttagaagtggtaagtatagttctatttttttttgcaataggttttagataatttttgtcttacaaaagtaaaagtgaatactcattaattctgaaacaagttagttagcttgctttagttagatagcaagagaagggtccctggaaagtccctggcccttgggtcagtgtctcatccctgcataatataaaaggaatcctggaaaaaatcaagctgcagacactaacaaggtaactagcacatggtgttgtgcttggagacctgcccatggctgcacagacagaaaaacctctggcatatttggataaaaacttgtacaaacctccagctcactgagataagggaacaagaccgacctggcatagaaatgcctttgtttgtccaggcacagtggctcatgcccgtaattccagcaatttgggaggcagaagtgggcggatcacctgaggtcgggagttcgagaccagcatgaccaacatggagaanaatacaaaattagccgggcatggtgcctcatgcctgtaatcccagctac

SEQ ID NO: 6907 - DNA, 494 bp, Homo sapiens
gatgctgaagaatatgacccgtcccatggaaaacattcaaaaatgtgtgtagcgctttcttcccaagggtgtgtgtgcgcatattttaacactaattcactttctacttccgttgctatcctttctgtgagtctttctcagaatctcagaaaagaaactaaattgttcactctagttatcaatgctgtactctatacctggaatttgctaaaagggcagattttaagtattctcaccacagaaaagagaaaagaaaatggtaattatgtgacgtggtggacatgttaactagctttattacggtgagcatttcacagcggatatccagtcatcacgctgtacacattaaacatgtacaattgggttttgttgagacaaggtctccttctgtcacccagtctggagtgcagtggctcagtcatggctcattgcagcctcgacctcctgggctcaatccatccttccccctcagcctcctgaaaagctggggccgc

SEQ ID NO: 6908 - DNA, 576 bp, Homo sapiens
  misc_feature 497: n = A,T,C or G
gattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagaaactgctccaggagtttgagaagcatgaggtccatcagtatcggcagtggctgaaggaagaatatggagagagccctttgcaggatgcagaagaagccaaaaacattctggccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaangatattctttagcaagagaaaatattttccccttatccccactgctgtggaggtttctgtacctcgcttggatgcctgt

SEQ ID NO: 6909 - DNA, 608 bp, Homo sapiens
gacagaggggcttttttgcgggaacaagatggcagcccccatacctcaagggttctcttgtttatcgagggttttgggctggtggtctcggcagccagttctggtgactcagtccgcagctatagttccagtaagaactaaaaaacgtttcacatctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagatgatagagagaactgatagagagaactgaacgaatgaagaagactatggcatcacaagtgtcattttattggctgggtgcggtggctcacgtctgtaatcccagcactttgggaggctgaggtgggcagatcacctgaggtcaggaatcgaaaaccagcctgaccaacgtggagaaacctcgtctctactaaaaatgcaaaattagccgggcgtggtggcacatgcctgtaatcccagctactcaagaggctgaggcaggagaatcgctt

SEQ ID NO: 6910 - DNA, 660 bp, Homo sapiens; identical to SEQ ID NO: 2044

SEQ ID NO: 6911 - DNA, 233 bp, Homo sapiens
gaggcagaggtcgcagtgagccgagattgcaccactgcactccagccttggggagagagggagactctgtctcaaaaaacatatatggagtaattatatatatcataaaagatgtataagtagaaataaagcactaggatatttaggattcaaatggtttattttgccatatgatattaaaagttgctttgaagtaagagcattttgtgttttccagtgaatgacagtggact

SEQ ID NO: 6912 - DNA, 645 bp, Homo sapiens
gatttggttaatggctccgttttcagcattgcaaataacaatctcagctactgggatgcccccctgggaagttcttatatgtgcaacaaagagcagactgtttcagtgtctggagcatttcaaataaatacctttgatctaagggtccagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatg

SEQ ID NO: 6913 - DNA, 466 bp, Homo sapiens
gacgcgcgggctcgcgcttcggtttccccagacctgctcgcagcaccctgctgtcttcccggtccggcccgctgcccgcggctccagcaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttga

SEQ ID NO: 6914 - DNA, 426 bp, Homo sapiens
gacggaggtgaggtttgttaccgcgattctgagaggtgggcttttagtccctccagacctcggctttagtgctgtctccgcttttctttcaccttcacagagaattctgcttggtcagaatcgtgatggcattgtgttcagcactgatgactattttcaccatcaagatgggtacaggtataatgttaatcaacttggtgatgcccatgactggaaccagaacagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagc

SEQ ID NO: 6915 - DNA, 502 bp, Homo sapiens
  misc_feature 411: n = A,T,C or G
ggttataactatcttttgggaaaggatgccattcctaaaattaactcccttctggcaaatttctccctgccaggtacctaacctccccagcatgatgtttttctaccatttgccttttggattcctagaagtattttatttggatgtgactggtttgaatttggagcttttagagcaagacatttggaaagatagcatgtgagtgaatttatgtatggaatgaatgacatgtgagaaaactcttgttagacatgatgtttcctatacagaagaaaagatacaaacttgattgcttcagtaaaaacacttttagagattgtgtttccttttttgtgagacagcatctcgctccgccacatacactggagtgtagtggcacaatcttggcttactgcaacctctgcctcctgngttcaagtgattctcgtgccacagctacccgagtagctgggattggatgcacccaccaccacacccagctaatttcgtatttttagtagag

SEQ ID NO: 6916 - DNA, 496 bp, Homo sapiens
cagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagtccgactttgatggtcctcgagagaagatgcagaaactgggagaaggtgaagggtctatgaccaaagaagaatttgccaagatgaaacaagaactggaagctgagtatctcgctgtgtttaagaagactgtttcctcccatgaagtctttcttcagcggctttcttctcaccctgttctcagtaaagatcgcaactttcatgttttcctggaatatgatcaggatctaagtg

SEQ ID NO: 6917 - DNA, 481 bp, Homo sapiens
gggccgctgtgcccatcacttccggtcgcgccagccgcccgttgccagttctgcgcgtgtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagtt

SEQ ID NO: 6918 - DNA, 440 bp, Homo sapiens
acagaaggggattagggggctaagcatttagttactgcatggggcagccaataataaaatcacagccctgtgtatttacctccacagtgtgtgctgataagtgcaaaaggtttgtgcaaattcttttgaagttatattgtaaccatggtatatgtattgaaaacttggccattttaccccattcctatgaatgaaaactatttggtgaatcagaggatagtctgaattgggatatgaaggccagtataagtgtcagttagcaaagtcagctctagtttagttttttttttttttttttaaggcgtaccattactaaaagtatagctttgggaaccttgtagcatcttaaaaacttttaaagggttgacagctattggcaaattgactaatacagagaactaaactttggttcatgtattcaatgtctaaatgaaaaatgg

SEQ ID NO: 6919 - DNA, 366 bp, Homo sapiens
tatttcagaaaatgtttcctcattgccatccccacaagattttaattccacacatatactgtatatctctttatgtactatatgtatatctgtactttgtacataaaaaggctaagtatagagcttactgtttttattcaatacaggctcaagaagagccgaataaagcatttaagctgaaaattaaattaaaaattaaagacctattaataccaaatttagctttgcacctatacttgctgaataacttttcatgtaatttatttacttatatatatatatatatatatcatcacaatgtgtcaatttacatacataaattagcgattcataaaaaacaacagcgatataataaattcttataaa

SEQ ID NO: 6920 - DNA, 284 bp, Homo sapiens
gtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgttttttgtggttttttttttttgagggggatttttgctttgtcacccaggctgaatggctggggggcaatttgggttaattgaaacctttgtttccggggttaaaccttttttcctgtttaaccctcccc

SEQ ID NO: 6921 - DNA, 646 bp, Homo sapiens
  misc_feature 577: n = A,T,C or G
acagaagggatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtnggtaaaacttaggaagaaccacagtgagaagaaaatcgtcctgatgctgatcatctgcagctcgggcgt

SEQ ID NO: 6922 - DNA, 626 bp, Homo sapiens
gacagaggggacgctgtttttccttttcgttggcgctttatagctacacagtgctatgccagagccagcgaagtctgctcccgccccgaaaaaggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcagggctaccctgagaggaatctacatgcagagaagttcaggagactgaactaacggaacgtcaggaagcgctgcgggctggagagctgctgttggaacagggaggagttctccgggccgcaccctgcctccgtcccgcaggtggagtggctgaaacttctcagcaggcgcatctacactagtgacctgaggagagaaaccctaaccccacaatggctgcatcttccctgaagacgagactgatgctcatctttgaaatgaagggcagtgtgtgcatttctccatgaaggtatccagaaacagccatgccagagctgctgtggggtggctgaactgctattccttttct

SEQ ID NO: 6923 - DNA, 525 bp, Homo sapiens
ttgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagagactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttaccgt

SEQ ID NO: 6924 - DNA, 489 bp, Homo sapiens
taaataaaaaatcaaaagtttcaaaatcaccatgttggaggattattgatgaactttggcaatttgtatcagcaatttgaactttgacaatttgtatattcagttttgggtgggccaagaaataaattgctgtgtgattgagatttatgctggaaacagctcagttttaatagaatatccacatgtcatcactatctttattcttctcttcattccttaaggaaaggaaccatatatttttctttattagcacctgttcagcgcctagcagtatactttttgatgaatgaatgaaagggtgtggtatgtatgaggagtacaaggaagagcattacagattgagggaaccccagggaaatcaggtacttattcttgttatgcactttaagcttttaaagggaaagaaaagtaaagaatacaatgagaaggaaatgttatagaattctagaacttttgtaccactttatagcagaatgccttgcacatagt

SEQ ID NO: 6925 - DNA, 76 bp, Homo sapiens; identical to SEQ ID NO: 2053

SEQ ID NO: 6926 - DNA, 90 bp, Homo sapiens
cttgggaggcttcccctcactatcctaccccacccgctccttgaagggcccagattctaccacacagcagcagttacaaaaaccttcccc

SEQ ID NO: 6927 - DNA, 406 bp, Homo sapiens
gccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgt

SEQ ID NO: 6928 - DNA, 378 bp, Homo sapiens
gtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccacaggggtgactggtgcccacccaagactgcaccagtgcctgctcgttgaggagagtaactgctgg

SEQ ID NO: 6929 - DNA, 535 bp, Homo sapiens
gacatagcactgggtgaaggtcaggttgacatgcttgcattcctggcacgtgttgacctgggtacttcctgagtaccaggtataccaggatagctggccgggccatctgagcccttcagagagccccaggaggatgctagttacccatctgtggcacctgatttctacctgtgacgtcatctgtcttgttctcttttaaaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctattttccagctctgtttgaactggaaaggggagaaaaccaaccaacgatgacaacattcgggccatggagggcgaagtcaatgtgtgctac

SEQ ID NO: 6930 - DNA, 79 bp, Homo sapiens
caataatccccatcctccatatatccaaacaacaaagcataatatttcgcccactaagccaatcactttattgactcct

SEQ ID NO: 6931 - DNA, 521 bp, Homo sapiens
acagaaggggaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccacttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggaga

SEQ ID NO: 6932 - DNA, 501 bp, Homo sapiens; identical to SEQ ID NO: 2057

SEQ ID NO: 6933 - DNA, 90 bp, Homo sapiens
gccatacgcttttcttgagtttgacagcatcattcagaaagtgaagtggcattttaactatgtaagttcctctcagatggagtgcagctt

SEQ ID NO: 6934 - DNA, 435 bp, Homo sapiens
acagaagggataaaataagaattataaaatgtaaagtgaatggaatgcattgaaatttgatcctgtagcaaagtcatcccttttgaattttgaacatttgtttaatgcctcttttccaagcatattttgaatattcagagataaatgagcaagttactgccatcaagaaactcctatttttctaggagagaaaggggaaagacgtgtagttgtacacatatggtttgctctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgtatttggagaatctccta

SEQ ID NO: 6935 - DNA, 500 bp, Homo sapiens
gggaaggataattagctgaaagctatgatgatataaataaaaacagctctccatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgc

SEQ ID NO: 6936 - DNA, 50 bp, Homo sapiens
gcagccagtgtgacactgctttaaactgcatttttctaatgggctaaacc

SEQ ID NO: 6937 - DNA, 91 bp, Homo sapiens
gcttgcggccgcggtttttttttttttttttttaaaattaaatcccctttttttaaagtttcgccagtctgggtccccttttttttttaaa

SEQ ID NO: 6938 - DNA, 616 bp, Homo sapiens
gacatgattacgaatttaatacgactcactatagggaatttggccctcgaggccaagaattcggcacgaggcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggac

SEQ ID NO: 6939 - DNA, 508 bp, Homo sapiens
gggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggaggggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctg

SEQ ID NO: 6940 - DNA, 156 bp, Homo sapiens
ttgcggccgcggattttttttttttttttttttttttaacaaaaaaaaaaaaattttatttttggttttccaaaaattttttacttgggggctacttaaattttaggggggaaccaaaattttttaaaaaaaaaattttttttaaaaacaaaattt

SEQ ID NO: 6941 - DNA, 619 bp, Homo sapiens
ttcggcacgaggcgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttaga

SEQ ID NO: 6942 - DNA, 530 bp, Homo sapiens
aagcttgcggcctctcattttttttttttttttttaaggggaaaaacataaacctgtttaaacaattttcttaaggtaaaattccttgaaataccttcagttgggagggataccccccctaaatatcctcttaccttttttttataaaaaaaatgccagggggggggagggaaaagtaccgggatacctttttaaaaaattttaaaccccccatttaggggttttttttttttgcaataacaaaaacaaacacttggaactgcagggccgtccccccccccccggttaatttttgttttttaaaaaaaaacggggtttccccattttgcccaggctggttttaaacccctaacctcggaatccccccccctcggccccccaaagggctggaattacaggcccatccctgcagtctaaactcctcagggccctgaggcggaaaaatcctttaaccctggaaggcaaaggctgcattgacccaaaattgccccactgccctcctccctgggcaacaaaccaaaacttcccct

SEQ ID NO: 6943 - DNA, 57 bp, Homo sapiens
aacggagcccccaagtaaagcacaaccctgaaagattatgaactatgaattgtctct

SEQ ID NO: 6944 - DNA, 440 bp, Homo sapiens
acagaaggggtaagtttccagtttaatgcagctgcagagactgcgtcccacccgaccgcctcccaagatacagcgctcgaggcccgtgagtagctggtggttctgccctccccacctaacactgcctgagccattctccctcagcctgactaaacctccagagtttggaccctcctgcctggcaaaagaaaactgggaattgggtttttcagcttccctctctgtgtggcatgaacttgagcttgcattctctgggcttctcttgctttttcgtgaataagtttggtgacttgcagatcagagccataggtagcaagggggccactgtgtgctgcgtgtgctgcgtgtgcattatttgagcaagtctcctagggtgagcaatgggttggaagccttcctccagacgtctgttcctcacaaacgaagcagaagtccggggg

SEQ ID NO: 6945 - DNA, 459 bp, Homo sapiens
aagggaaaactatttgtgtagagacacatgtctgtaaatacacatagatatattaactttttaagctttaattgaagcctttctcttcacaggttttatatatttgactgcagatgactaacagattgaattttaagagtgcgaaacactctggtgctatagggaaggaacttcataaatagcccctcctgtaagggaccagtctttaatttaaaacagtccagcccaggaatcttgcaagaattttgtaattatttgaggagagatgtagatataccctggagttctttgactttaagttattctagagtcatcccagagatggcctagaagacttgaatgtaccccaaaggattctgaatccctttgggaaatttagactatgattttcagtaagaattaaaagccccaggataagcgtggtggttcacacctgtaatcccagcaatttgtgaggcc

SEQ ID NO: 6946 - DNA, 523 bp, Homo sapiens
gggaaaaatattatctataaatggtagatacaactttcgaaagtctggatacttaggtgatatgagaaatgaatataattaaagtattagagaatattgttgagatttttttttcttagttgtcttgctttttcaattaaaaaaattagaggaatattagaaatgaatttaataatcctggaagattaatccctctttgccaagttaaactcaaatgactagaaaaaaaattaacttgtgaccttaaagtgtaattgaaattcagtaaactttaggagctagaaacctcaaagaccaaggccagatatattatacttggcatattaaaataatttcctgtttcatcagggttggtaagaaatgaataaatattcataagaaggatattcatttgaacattcaaatgaagcctaaattagcaggagaagggaaacctttgaagtttattaactaaaaattaggaaataaaatggttttttaatagctgagtgatttaatagtttgtctttgatttaatgaatat

SEQ ID NO: 6947 - DNA, 405 bp, Homo sapiens
acagaagggaagtacaataagactgtcccattaatttgtttaaaaatctctaattggttggccatagctgactatgtaaataaatatttatgcttgccttcagtcaacctgtattacttcaataatgagaaatctttaaaaaaatgtccttcaaaacctaaaagtatggtcaagttttatagtcatataaagctagcctagacaggaggatattttatcacaatgttacaaattggattattttattaatctctttattaatcatagaattctatggagttcaactggaaattgtagattgttaaataaacaacttttaacacataaaaccctgatgatggaataggaaagatcagaaaaatagaaggattttttaaatccggaagaagaagaaaaaaaaaaaca

SEQ ID NO: 6948 - DNA, 531 bp, Homo sapiens
ggaatgtcaggtacgtcttcattgattttacatcccagcacctagcagcacatatgacagaacaggtgaggtgctcaaaaagaattttttgtttcgaccatctataaagttgaatgtaagaggccatggaatgacctgtttgttcatctcattgattcattaagacatggaatgtaaaaggccatggaatgaccatctactgaaactaaaattagacattttaccataattatttttaaaccactataagtagatattggttaaaaactttattattgataaactcatgctgggtgagttttttaaaaactttctttcataaagtcacaagaaaaattgctatatttgaagatcttcattgtatatttatacaagttagcaaatgctgcctaacaaaccacctcaaaggtaattgcctaaaacaacacacgttattactcttgagtttgtgtatcagcagaatgactcctcctgtctcagtttgccttcattgtgtatctggagtcagctgtgcatcagtcagtcaactct

SEQ ID NO: 6949 - DNA, 54 bp, Homo sapiens
tgtggttctgggcaagatgcctcacttctcctcctggcctcagtttgcttttct

SEQ ID NO: 6950 - DNA, 221 bp, Homo sapiens
ctttgatatctgatcaaatgtatagacttggctttgttttttgtgctattatgaaattctgatgagcattactattcactgatgcgggggggggttcttttgcataaaagacttttatttaacactttggacttctatgaaatatttaaaagtgctaatttctggcccacccccaacaggaattctatagtaaggaggaggagaaggggggctccttccct

SEQ ID NO: 6951 - DNA, 518 bp, Homo sapiens
gattcctttcacagagggctgttggtagcccttgcttagaatcagtttttttttatctagagaagatagatttgcttgagtcctaccacactcacatacttttgtgagatggctgcttatggaaaggatattgtttttctttgggacagttatgatcttggcctctgatactaggatctaataaagcaagctgactagaaaagtaaaagcagtagttctgtgtaatgtgtgagctgtgaatttgttgctttcaagctgtttgttgtgttgtggcctgttctagtggactgggatcctgaggttttataacttaattttattgtagtagtaggcaaaatgctctttgtacctcagtttcctttcctgctctgtttcctcttttgagaagataaatgtgtacacgttaattctcccagtttcataacatgatggtgaaagaaaatactgtaaccaggggtgttttttaaaaaatgaagtgcaaggttgatagcaatttttgcatataaatgagtattacc

SEQ ID NO: 6952 - DNA, 129 bp, Homo sapiens
gtcttttaccaaggacccgccaacatgggccgcgttcgcaccaaaaccgtgaagaatgcggcccgggtcatcatagaaaagtactacacgcgcctgggcaacgacttccacacgaacaagcgcgtgtgc

SEQ ID NO: 6953 - DNA, 566 bp, Homo sapiens
ggaaaagttcttgacaaagagttagaagaaatgactctgaaaactccgaatttgaagatgacggctctgaaaaatgttagatgaggaaggctctgagagagagtttgacgaagattcagatgaaaaggaagataggaggatacatatgaaaaagtatttgatgatgagtctgatgagaaagaggatgaagaatatgcagatgaaaagggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttc

SEQ ID NO: 6954 - DNA, 472 bp, Homo sapiens
acagaggggtttgtttgtttttgagatggagccttgctttctcgtccaggcaggagtgcagtggcacaatctcggctcactgcaacctctgcctcctgggttcaggcgattctctgcctcagcctcccgagtggctgggattgcaggaacccgctaccacgcctggctaatttttgtatttttagtagagacagggtttcaccatcttggccaggctggtcttgaattctgacctcaagtgatccacccgccttggcctcccaaagtgctgggattataggcatgaactaccatggccagcctggatttggatatttctttagatagaatatagtatccctatatcctaggaatttttaacttattggtgcttgctatctaaaactcaagaatcaagtagaggctgggtgtggtggcctcaccctgtaatctcagcactttgaggggctgaagtgggaggagcagttgagcc

SEQ ID NO: 6955 - DNA, 76 bp, Homo sapiens
gtagtagagtttaacgtgtataagctaaaagtgaaagtaactgagtgttctcttgtttctttgcattaatgtaact

SEQ ID NO: 6956 - DNA, 480 bp, Homo sapiens
  misc_feature 347: n = A,T,C or G
aaatcttttaaaacaacacacacacacacacacacacacactcacatactcacccacaaaaaacccaccaaaacttctgggttggatctggtgaggtcacaattttggatttggttcccacgtggtccagttttgttattatggagtaaatctgtgtttcagaggccaccatatcacatttctcgagtctccttgtagacacctaacttgtccgtgatgatatgaggtaataacaggagataatgattcagcaaagctttgtcccgccactgagaaattgctttgaaacagtggcccatccacagttgcaaagtgggggtgattcttcttcagggagcatagcgtancagattttcccctgcgtcctctgtgtttgttcctcagtgtctggaaagtgcttaccctagagagtgagcttgggaccatttttattaaagctattattattattatttgagacaaagtctcactttgtcaccc

SEQ ID NO: 6957 - DNA, 454 bp, Homo sapiens
gagaaacttatactaaaactattactcatcagtcattcactgatcagcagctaaagtccatgagaccaaatggttttatatggaaccaacaaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatccagtacttt

SEQ ID NO: 6958 - DNA, 568 bp, Homo sapiens
acagaagggagctttattcagattattctaagtctggcatgaactaaatgtcttaaattgttatcctaacaattggtaacctcaaattgatctgtagatatatgtgatgatcttttagataagagtacctaagaatgggtcagacacagtggctcatgcctataattccaacactttgggaggctgaggattgcttgagcccaggagttcaagaccagtctgggcacaatgacaagaccccatctctgcaaaaaattacaaaattagccaggcatggtggcgcacatctgtacacccagctactcaggaggctgaggcagaaggatcccttgagcccaggaatttgaggcaacagtaagctatgattgcaccactgcaatctggcctgggctataaagcaagactctgtctcttaatttttttaaaaaaaggtacctggcccaggcatggtggctcatgcctgtaatcccagcactttgggaggccgaggtgggcagatcacaagttcaggagtttgagaccagcctgagcaacatggtgaaaccccatctctactaaaaatacaaaa

SEQ ID NO: 6959 - DNA, 427 bp, Homo sapiens; identical to SEQ ID NO: 2065

SEQ ID NO: 6960 - DNA, 226 bp, Homo sapiens; identical to SEQ ID NO: 2066

SEQ ID NO: 6961 - DNA, 516 bp, Homo sapiens
acagaaggatggaaacatccccaccacctattaagagatgagacttccatgacagatgggctaattacaaaattgattgattggctttgggttgccttgcaatgaaatgaatggtagaagcaatgcactgtcttctcccttactatctccctccttttgggaacccaagatccaatataaaatagcacacttaattttggcgatctgcctttgcttcactgtgcctgcttattaagccctaaagatgcatgctttcctggccctgttcctccaaaggctccaccctgaagccagtaatccaattaagaaactagaaataaaaaatcttacaaacactaaatcttcagactgtctgtctgtctctctctctgtctctctctctctctatatatatatatatagtgtgtaatgtctataaaaacgaagctataattaattggcttaaaaaataagcacttaggtggctcacacctgtaatcctagcactttgggaggccgaggcgggtgaattgcctg

SEQ ID NO: 6962 - DNA, 436 bp, Homo sapiens
acgacagagggggaggctgaggtcaatcacttgagcctgggaggtcaaggctgcagtgagttatttatttattgtgtttatttactttatttatttatttatttattatttttgagatggagtttcactcttgtcgcccaggctggagtgcagtggcgtgatctcagctcactgcagcctccgcctcccaggttcaagtggttctcctgcctcagcctcctgagtagctgagattacgggcacctgccaccacacccggctaattttttgtgtttttggtagagacgggatttcgccatgttgggcaggctggtctcaaactcctcacgtcgggtgatccacccaccttgacctcccaaagtgctgggattacagacgtgaaccaccacacccagcctgctacagtcagttataatcacaccactgctttccagtc

SEQ ID NO: 6963 - DNA, 535 bp, Homo sapiens
acagaagggatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttggctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttc

SEQ ID NO: 6964 - DNA, 263 bp, Homo sapiens
cgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctg

SEQ ID NO: 6965 - DNA, 127 bp, Homo sapiens
tctgagtggaggatcaatgaataggtgatgaatgaatggatatctacatgtcagtgcattgacagtgaatacatcttgcttatcatagtgaaagaaacagccggacacagtggctcatgcctgtaat

SEQ ID NO: 6966 - DNA, 116 bp, Homo sapiens
gcaacatagtgagaccccacccatctcaatttaaaaaaagagagaaaaaggccaggtgtagtggctcacgcctgtaatcccagcactttgggaggccaaggcgggtggatcacctg

SEQ ID NO: 6967 - DNA, 504 bp, Homo sapiens
tggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactacc

SEQ ID NO: 6968 - DNA, 501 bp, Homo sapiens
agagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttct

SEQ ID NO: 6969 - DNA, 379 bp, Homo sapiens
cttatgttactctcctttatgtttcactttctcaaatgaatgtcaagctggtgatttttagattcaaaaattctaaaataaattgctcaaatttccacattatgtaagctattaataaaatgtcttgtgggtgcgaggtatttattaaaatttttggttgtaattttaagctcactgcaggcagaaaggaatcattaacatttatattcttttttttagtctgtatctaaatgatggtatattttaattccagatattttctttatactgcagtaatgctcgtcatattttgcaaaagtgatgttgttcttttatttggaaatataaggcttttttagctcctgaaatctatattatagtcatataattttattatgtt

SEQ ID NO: 6970 - DNA, 508 bp, Homo sapiens
gatattaatatttttcaaatatgtttgataaaacattttttgaaactttaaaagtatccagaaaacttaaacataaacatttaaatcatgcattttaaagatgattgcttttctcctaaagtgtgttgttaaaatattcctgattgtcataaattgggaatgggtaatctctcagtgccttcataaaactctattcaacttaaatgactgaagattatgacataaattaattttcagagatagttttgaattattttaaatacacaacttttttttttttcaagactctgtcatccaggctggagtgcagttgtgtgattccagctcactgcaacctccgcctctggattcaagcaatcctcctgcctcagcctcccaactagctggtactacaggcacgtgccaccatgcctggctaatttttgtatttttagtagagatggggtttcaccatgttggccaggctggtcttgaactcttaacctcaggtgacctgcccaccttggcc

SEQ ID NO: 6971 - DNA, 533 bp, Homo sapiens
agttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgc

SEQ ID NO: 6972 - DNA, 401 bp, Homo sapiens
aattatgtagagttaggtccctaaacaaaattctttgtttctcttgtatttcttcttgttcttgtcttgatttttttttttttcccttctttgttagctgggttctataattatgagagtagcacctttgaggcatttgatagttaccttagggatatttactgatcacagtaaagcaccaaggtactgcctggggagtagttgaataaaataaaaaaacttcagaagtaacttttattgttctcttactaaatgaagtgatgagtttatagccatcttttatcagttaggatcagttagcttttttgttggagtcagtgcttttgattacaagtaatagaaaatcctgataactctctttaaacttcagggaaattcattatctgtcataattagtccaa

SEQ ID NO: 6973 - DNA, 493 bp, Homo sapiens
tggtaccacaataacaaaaataaggaagataatcctggattgagttgctaactgctccctggccttctgtaaccaggctgaatttagaaagataataatgactcatactccttttttagatatgtaaaatttgagcagctggcaggagagctaagtgtatgtcagacgttgggaaatgagaacggaagctcagagggataagtggagttgccactgtggtttacttagactagctcatatttaatcctggctgattctttcctttactttaaactcctgttctaatctttgatgtacaaatccatatattgactttataaaaggttcaaatatataggagaaacaaaagataatctgcaaataggttggtggtctccagattgtttaaaaatcaccagaaatgattccacaatctctaccattttaaaaacataaaacttttctaaagacttgtcacacctaatgtatgagaacaaaagcatgtgcaatgttt

SEQ ID NO: 6974 - DNA, 97 bp, Homo sapiens
aataaaaataaatttgaagtgtattgccatcttaacggaagttgttactggtggacggtatccaagttactggtggtaaatctgcagcaacctcaat

SEQ ID NO: 6975 - DNA, 433 bp, Homo sapiens
aactattgttttatcctgtctttgggggcaatgtgtcaaaagtcccctcaggagttttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaattgccctgcctgcccatctcagagccataaggtcatctttgctagagctatttttacctatgtatttatcgttcttgatcataagccgcttatttatatcatgtatctctaaggacctaaaagca

SEQ ID NO: 6976 - DNA, 445 bp, Homo sapiens
attcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagat

SEQ ID NO: 6977 - DNA, 474 bp, Homo sapiens
aactatcttttgggaaaggatgccattcctaaaattaactcccttctggcaaatttctccctgccaggtacctaacctccccagcatgatgtttttctaccatttgccttttggattcctagaagtattttatttggatgtgactggtttgaatttggagcttttagagcaagacatttggaaagatagcatgtgagtgaatttatgtatggaatgaatgacatgtgagaaaactcttgttagacatgatgtttcctatacagaagaaaagatacaaacttgattgcttcagtaaaaacacttttagagattgtgtttccttttttgtgagacagcgtctcgctccgccacatacactggagtgtagtggcacaatcttggcttactgcaacctctgcctcctgggttcaagtgattctcgtgccacagctacccgagtagctgggattagatgcacccgccaccacacccagc

SEQ ID NO: 6978 - DNA, 186 bp, Homo sapiens
tagcctctgctactcgagaggctgaagcaagaggattgcttcagcctgaggaagtcgaggctgcagtgagccatgatcgcatcactgcactctagcctgggtgacaaagctagaccctgtctcaagattaataaataaataaagactcatttctacagtcagttcctgtggtctggattagtgttg

SEQ ID NO: 6979 - DNA, 529 bp, Homo sapiens
ttatcagttgatgaatctcaaagtcttgccgtcttaagaaagggctttttcatcgagtgcttgaaatgtaggtttgtgagttgatcagaggcctcaaagcttcaggtgggttgaagttgcaatagataattctttgtattctgactttgaaagcgtttattttcacttcagtgtccaaaattttcacacacagaaaagttgaaaaagtgatagatacatatgcatatatactctttctagattctatgacgttttgctgtatttgttatatttgcctacaaaaatgattatttatttatgtggagacggagtttctctcttgttgcccaggctggagtgcaatgccgcgatctcggcttaccgaaatctccgcctcccgggttcaagcgattctcctgcctcagcctcctgaggcaggcatgcgccaccatgcccggctaattttgtgtttttgttttgttttgtttttgagacggagcctcagtttgtcgcccaggctggagtgcagtggcgcaatctccactcactg

SEQ ID NO: 6980 - DNA, 541 bp, Homo sapiens
gttttaatcattttgggtgttttcaaaacaaatggtgagattaggggttttttttctcttctatttttggcccctttcctctggagagtccttctcttgtgtttagttcttggtgttcttagtatatttgaagaatgcttttaagtatttgaaatgtgtgtacatggttgaaaggggatgaggaagaagaaaccgaaaacttcatgaccctgctcaaaccaatacccataccccagccctaaagcagtgtccgggcaccacatcttcaaggaaggccccttggaaacccctcatgggccagtcctctgacccaggtgatctcctaaccccctttatgtattcttatgaggatatatgataaagaacggactgtgagatttgttgttcaaatttttccccttagaatgtgagctcagtgggtaatagtaccatgttggctctgtccacagttctactatcttcagcatagggcctggtatacagtaagcgcttaaaaatacatgtcaaatggctgggtgcagtggctcacacctgtaatcct

SEQ ID NO: 6981 - DNA, 51 bp, Homo sapiens; identical to SEQ ID NO: 2074

SEQ ID NO: 6982 - DNA, 391 bp, Homo sapiens; identical to SEQ ID NO: 2075

SEQ ID NO: 6983 - DNA, 405 bp, Homo sapiens
gatattatctgtgtagtagcctgtttaaagtgatcattgctagtgcatggtatagaattacaaacttgtaaatacttctcaagattgccactttaaaaaaaaaagcaaaaagagctctgtagccctatttttttttttatttccaacaggaaatttgttcttgtttcaaaaggggggaacacccattattctctgttggccacatgaatgtcatccatttgtttattgcagcaaaaaaaaagtgaaaaatggttgatacaggggcaagctgttccttttaggttactttaaaaagtcatggaatttcggatttacaaagaaagcataaggaatactctaaccagtatatatgtatacagtatccagtataaaaatgaaaatgtaatgtagttattaaaacattat

SEQ ID NO: 6984 - DNA, 588 bp, Homo sapiens
  misc_feature 521: n = A,T,C or G
gatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatntctggctgaaagtgggcatctctgcaggcacctgtactgccatcctgctcaccgtcttgacctgctt

SEQ ID NO: 6985 - DNA, 54 bp, Homo sapiens
agcagcacttttattttgcacattgataatgctgtatgtatactttcttttttt

SEQ ID NO: 6986 - DNA, 486 bp, Homo sapiens
gacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgatac

SEQ ID NO: 6987 - DNA, 471 bp, Homo sapiens; identical to SEQ ID NO: 2084

SEQ ID NO: 6988 - DNA, 608 bp, Homo sapiens
agcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcg

SEQ ID NO: 6989 - DNA, 509 bp, Homo sapiens
gacagaaggggatggcaggtttggtggggcaacaggtagcagtggaactagtagaaaatattcatgggcagcgggacccatggtgaagtcactgtgttcttctctccaccctcacccaatagagatttaggtcaaaggagtaatggtgactacaagaataaggccttccagaatcaatctagaggtggatgccacagagatccagtggttcagatttttttctgaggtcactctgaaagatttctcctgtaaaacagtcagctgcttgtttctgtcttgtgatagtagctgggtagcttcctttcctctacaggaactcttactaggttccatcttcctgtccgtgattgaacttctggactctcctaataagttctctctgcatttttatgatgtagtgcttcaggtaatcagccaggctccctgcaggcctcttctacctgcctactgtctaacaaataggaaggctgggcacagtggctcacacctgtaatcccagcactttggga

SEQ ID NO: 6990 - DNA, 576 bp, Homo sapiens
acagaagggactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacgtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctc

SEQ ID NO: 6991 - DNA, 572 bp, Homo sapiens
acagaagggagtgacattagagacatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccacttagtggttctttatttaaggaataactcagctgggtgcagtggctcacgcctgttatcccagcactttgagaggctgaggcaagcagatcacttg

SEQ ID NO: 6992 - DNA, 566 bp, Homo sapiens
atgggaatattctgtttctggaacataccacacccaatgcctccaggacctaaggctctttaaaagaaaaacagtgcttaaaaaattataagcgttatacacaggctgagcacagtggctcatgcctgtaatcccagcactttggaaggctaaggcgggaggattgcttgagcccaggagttctagatcatactagcctgggtaacacagtgagatcttatctttactaaagataaaaaaattagctgggcatggtggtgcacacctgtagtcccagctacttgggagactcaggtgggaggattgcttgagtctgggacattgagactgcagtgactgatgatggcaccactgcactccaccctggacaatagagcaagaccttatctttctttttttttgagacagagtttccctcttgttgcccaggctggagtgcaatagggcgatctcggcttaccgcaacctcctcctcccggattcaagcgattctcctgcctcggcctcccgagtagctgggattacaggcatgtgccaccacactcggctaattttgtatttttagt

SEQ ID NO: 6993 - DNA, 499 bp, Homo sapiens
gtgaccaacagcaaacctgaatttagcatttcttctttaaatggactgatgtacagttccaatcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctc

SEQ ID NO: 6994 - DNA, 490 bp, Homo sapiens
acgtcctccgataacaaaaatccttgcttcctctgtctgtgactttacacgcagttgttcaaagttgttaaatgtcaagagtcaatcacatccctaggacatacctcccaactctcctgactcttatgttattgaaaaaacaaacaaacaaaaactcctttatgatgatattcaacttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttg

SEQ ID NO: 6995 - DNA, 486 bp, Homo sapiens
ggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagt

SEQ ID NO: 6996 - DNA, 600 bp, Homo sapiens
  misc_feature 472: n = A,T,C or G
acagaaggggagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaaagggtacccagtgtgttgaacaaattcaagaagttggttctancgcttctgtgagaagaactgtgaaaagagcatggttgaacagctggacaagtttttaaatgacaccaccaagcctgtgggccttctcctaagtgaaagattatttaatgtccctcacagatcgctctg

SEQ ID NO: 6997 - DNA, 604 bp, Homo sapiens
atatcaactttcagaattacagtaagtcagagcaaagagaatgaaatctgtagctcagcttgtttatttttttggtttgcttctgctgaattttgtttcccccaagtcagaatacgagtctttttgtgttctctctcttctcttattcttccgagaagtgaaggtggtgggtgtacagcccatatttgtttactttttctgtagctcatatatctattattactggtggtttcttagtggaaatttttctttcactctcactttggctttacctccaagtgctttcttctcttggctgcaattgagcactataatttgtggctttccggagggggagccttggtggtcaggtggaggaggcaggccacattccaaaagtggagtggtaggtgttccagacagagtgctgattcaagagtgagtaggggtgtagggtgaaagttggctactaattcaagcctcacctgaggcagtgttgctcaaacagaaaagtgccctctctaattagctgcccccctatgcgcttagattaatgacagccaactaacttagaaaccccttccagagtaagctagccaaacaatagatgttccatggacatgac

SEQ ID NO: 6998 - DNA, 373 bp, Homo sapiens
gatattcttttttttagtctgtatctaaatgatggtatattttaattccagatatttactttatactgcagtaatgctcgttatattttgcaaaatttatgttgttcttttatttggaaatataaggcttttttagctcttgaaatctatattatagtcatataattttattatgttttgtggtaagaagtgcagcaacatattgagaacataataaaattatcctgtatttttaatgattatttattaaattcctctcattagagcctgttattaatgattgtaatgtattttctgtataattttactgcaatttattaaattctaatgacttaaattgtctgcttttcatgagtgcacacagttgaatgct

SEQ ID NO: 6999 - DNA, 531 bp, Homo sapiens
gttattgggaaaatttcaatttgtcagtttctcagcttggaaaagtcacctgaatgactcccacacctctacccactcatctccctgtcttgtggggggtatctgacctctagtactggtgccaggaaaggtgatagaacagtggttctcaattttgatttaattcatatgaactgtggctcgggcatcagattaaggcacatcaggtgattatggtgtacagccagggttgagggtcactgtcttcaaggaaacttctacacctcttacacagtggtttcacctgcagaaggaggcacctgtcctagactgctctagtgttcacaaccaatgataaatctgctgtgggtggagaatgcttgttgagccaaaagcctgcatccttcttgcttctgtcttgactgatctcatattccttcttgggcatagctcttggcaagcagtaaatcttcactctcccactgccgtcagccaagtgttcattttgtccaccacaaagataggtgtttttgggatttgataggttgcatg

SEQ ID NO: 7000 - DNA, 567 bp, Homo sapiens
gtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttactaaaaatacaaaaattagct

SEQ ID NO: 7001 - DNA, 529 bp, Homo sapiens
aagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaat

SEQ ID NO: 7002 - DNA, 658 bp, Homo sapiens
  misc_feature 91: n = A,T,C or G
gattctatgttggatattaatgctttgtttgctgaggctaaacactatcatgccaagttggtgaatataagaaaagagatgctgatgcttncatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgatatggatttaaactctccagttcctattttatgaaatgacttgcctttctggtatacaatgctgattttttagtaattgccttttcattact

SEQ ID NO: 7003 - DNA, 613 bp, Homo sapiens
acagaggggtggaatatttaagccacgagaataagtactataaaagcaagaatttataatagggtctttaatgatcagttctgttcttacacagcttctccccactcctactccttggaagcaaccaagtggtatgagttggcccctactcaccccctccctggtgtcagtggaccacatcagggaagtgaggttattttttcacttggaggaaacaaagatatgtaactcagtaccctacttttgccatgaggttgccagtgggtggagggagaagacaaacttccacctaaccagtctgcaagaaggaagtataagttagtactctacttttggtaggatggtattagtaggtcccatcaggaagataaacacgcacacccacccagctctcaggttacacatcaatagggaaccatctacgaaataataagagagaaaaattctcataatataaaaaaaaattcaggacacaataaaaatcacttataagacaaaagaactaggaaatcataacctgaatgagagaaagacaacagacaccaacacagacataaaaaaggggttggggctgggcgcagtggctcacacctgtaatcccagcactgtggga

SEQ ID NO: 7004 - DNA, 605 bp, Homo sapiens
acagaagggccgggcgcggtggcgcgtgcctgtagtcccaccttagcctcctaagtagctgggaccacagagagtctcactctgtcacctggggtggagtacagcagccggatctcagctcactgcaacctccaccccctgggctcaaccgatcctgccacttcagcctccagaggagctaggaccacagacacgcactaccaagtcaggctaagtttttggttttttttggtagagagggggtttcatcatgttgccaggctggtcttgaactcctgagctcaagcgatcctcaggctcccaacgtgctgggattataggcatgagccactgcacccagccaaattgcttcattttttattactccatacttcctacataagatacttcctacacctggccaaattgcttcattttttaaaaatatattttatttaatgtagtctcactctgttgccctggctggagtgcagtggcatgatctcagctcactgcaacctctgcctcctgggttaaagcgatttctggctaatttttgtatttttagtagagatggggtttcaccatgttggccaggctgctctcaaactcctgacctcaagtga

SEQ ID NO: 7005 - DNA, 517 bp, Homo sapiens
ggcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcatt

SEQ ID NO: 7006 - DNA, 507 bp, Homo sapiens
cggggtggaacttcttggccatggcggtgatgcagcggccggtgatgggcttctggcagccagaacacagcgagccgcgccgctcgtggtagtgcacctcacagtagggctgcccgtcgtgctcgaagaagctgccgttcacgaatggcgtgaagcattcctgccaggcggagagaggggctcagggagctgcccctcgggctagagctgcaccctgtgtgatggggccgaggtgggcatagtcggcacgctcggagtgactcctacttgctaggcgtttcccatgtgccgtgttgtcctaaacgctcatttttcatttttattttattaaataaattttttttgtagagatgggggtctcactatattgcccatgctggtcaaatgtggcctcctgcaatcctcccacctcggcctcccacagggctgggattatttagttctcccaacaggggaggcaactgaagcacacaggtgaagtaacttgcccagggtcatgcagctact

SEQ ID NO: 7007 - DNA, 517 bp, Homo sapiens; identical to SEQ ID NO: 2095

SEQ ID NO: 7008 - DNA, 552 bp, Homo sapiens
ggatttcttagatcagcacttctcattctgtggaaggagaagaaggtatcagtcacatagagggttttttcgcaataactcattacctggctctaaactagagctgtgtaatcagaatgggggaggagctgagagtaagagaacagatggagaatgggttggcattttgaaacagcttcaccagataaacttgaaatctcccagatttagaaccattcttttagattatctagcaagactggccaacattgttcggaaatctaacattgagatggtaatggcccaggcacggtggttcacgcctgtgatcccaacactttgggaggccaaggcaggcagatcacctcaggtcaggagttcgagaccagcctggccaacatctctactaaaaatacaaaaattagccgggtgtggtggcaggtgcctgtagtcccagctacacagaaggctgaggcaggaaaatcgcttgaacccatggggcggagcaggttgcagtgagccgagatggcatgactacactccagcctgggcaacagagcaagactatgtctc

SEQ ID NO: 7009 - DNA, 453 bp, Homo sapiens
gatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcact

SEQ ID NO: 7010 - DNA, 453 bp, Homo sapiens; identical to SEQ ID NO: 2097

SEQ ID NO: 7011 - DNA, 252 bp, Homo sapiens
agctctgatcaaatccctcctaagcagaacccttccaagctcccctccataaggctccaggggtttacttaccttgcctgtcagggcttctgcagctagcttactacctgctatctccactcctctccaaaccaccgataggctgaggcttctataaagcaaactctggcggcttggggttaatgggtctgtgtacccatgacactgtacctgggtgctgtcatctgcctgactgaccttcctgtgtcctgg

SEQ ID NO: 7012 - DNA, 550 bp, Homo sapiens
catggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccagagagtaaagactcaagatcgaaagaagacatcatgaaaataaatgaac

SEQ ID NO: 7013 - DNA, 78 bp, Homo sapiens
tgtgttttatgcacctcgtctgagaatcaataagcggattttggccttatgtatgggaaaccatgaactatacatgcg

SEQ ID NO: 7014 - DNA, 592 bp, Homo sapiens; identical to SEQ ID NO: 2098

SEQ ID NO: 7015 - DNA, 491 bp, Homo sapiens
gacagaaggcctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtct

SEQ ID NO: 7016 - DNA, 58 bp, Homo sapiens
gataccttcctggtgctatgcccccgtatgggcagggaccgccaatggtgccccctta

SEQ ID NO: 7017 - DNA, 673 bp, Homo sapiens
acagaagggacttacccaaacactaattgtagactatgccttctgaattgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagactcctcttcacacaagatggtagcaacaaatcataggtgcaattgcaccaaattcacagaagatcaattgaaaatcctcatcaataccttcactcaaaaaccttacccaggttttgctaccaaacaaaaacttgctttagcaatcaatgcagaagagtccagaatccagatttggtttcagaatcaaagagctaggcatggattccagaaaacaccagaacctgactttagatttaagccacagccatggacaagattaacctggtgtggagtttcaaaatagagaagccagatggtgttgtaccatctatagcacctttcaattacacacagt

SEQ ID NO: 7018 - DNA, 422 bp, Homo sapiens
ataacaagcacattgtcgatttcgtgagtattattgcttaagatcgggttaagtaataagtaaaccaattgaatattttatttcagttgaaaagaaaaatactgaagaattttaatgcctttaatggggtacttgagtatggcaaaaatcgggaaggctgagagtgtcatttgggagctgtgtcccaagtccctcgtgggcctttaatcagcagttacagatctgcagctcctcctgtaggatggaagcactttgctctttggccttttgaggtcacccagctatttgaaggtcaggggcaactcgattctaatgagatcaaggtcacagggtcatgttgcccccatgaaagtgggagatggagttctgtggtccaggctgtggccctgctgcagggctgggaggtggagaggtgtggacag

SEQ ID NO: 7019 - DNA, 372 bp, Homo sapiens
acagtagggatgtgaagtaagggagtggcatttggtttttttgtcagtaagtctgtcttgctcgatatctcaactttccaggaattacagtaagtcacagcaaagagaatgaaatctggagctcagcttgtttatttttttggcttgcttctgctgagttctgtttcccccaagtcacaatacgaggctttttgtgttctctctcttctcttattcttccgacaagtgaaagcgatgggtgtacagcccatatgtgtttactttttctgtagctcatatatctattatcactgggggttacctagaggaaatttttctttcactctcactgtggctttacctgcaactgctgtcttctcttggctgccattg

SEQ ID NO: 7020 - DNA, 113 bp, Homo sapiens
tacggttgcgaaaaaacgacaaaagggtacggttgcgaaaaaacaacagaagggtacggttgcgaaaaaacgacaaaagggtccggttgcgaaaaaacaacaaaagggtccgg

SEQ ID NO: 7021 - DNA, 463 bp, Homo sapiens
ggaagttgatatgcagtttattgaacaaacagagtgtacagtaactaaacgaactgtgtatttccaaaggaattaagaccgcatatctggattcacacctaaaagcacatagaaaattaaaccaaagaagggcaagttttgtactaaaatcacttgggcccaggttattctataagaagattctcactggcatttgatagtaacttatcaccttctgtgcgagcttgggaaccagctgactcagtgaactgcttcctgtcttcagtgcgtgatgacacagatgtgtcaagcttaatagaacttatatgtaaatttaagaataagaagttttatacccaccctggttttattccaaagttactgctctgcaattttgggctccatccttaggaagatactggaaaagcaagagaacctttctcagctgcctgtgtgaagtgacgttgttctagaacggtgccct

SEQ ID NO: 7022 - DNA, 198 bp, Homo sapiens
ctgaaaccttaagtgttaacatgagcaccttaataaagtttggacagtatttcttttataaacaatattaattgatattgctaactattaacattagaaatgaaagtcgagaaagataattacctggaacgttagtacccagaaatacccaattgtgttggtatttgttttaagttttcaatttttatgcatctccac

SEQ ID NO: 7023 - DNA, 847 bp, Homo sapiens
ccaggttcttatttttaatagaaaagagaacagggaaggaacacaggtcagtgtgaagaagggggtcatggtagacacagaggtggactgtttctctacctcctcacattgtgctaacagggacacagacagattcagaggcccttgcaaaaagagaagccagagtcccctaagacacataagggaggcgtgaggaaatcctgcatctcagtcgcacacaaggcagctgtgcatctcagtcgcacacaaggcagctgtctcaggctttacaagctgtgagactcagacccctgggcactgtcgctccactcagccttagagtagctccctccttttccacctgagctcttcttcctccatatcacagcagcaaccacagctccagagaccacagatccaaggagaaccaggccagcaatgatgcccacgatggggatggtgggctgggaagcgggcttccatctcagggtgacgggctcgggtagccctcatgctgcacatggcacgtgtatctctgctcctctccagaaggcaccaccacagctgcccacttctggaaggttccatcacctgcagggctggttctcaagagctcggtgtcctgggtatggccctcaccatcctgcctgaaggtcagtgtgattttcgcaggtgagaagccaagggcccagcacatcagggttggcctaatgtcagagatggggtggtgagtcaagtgtgtcatatgggagttcaggtgaagaaaggtctccttcccctcatacagttatttggggaacgaatccacgaatgtggcttgcaagtaggggtctttggtggtccgcctcagaaggaaaattggactttt

SEQ ID NO: 7024 - DNA, 619 bp, Homo sapiens
ccagttttgtccaaaataatttatttaccagccttacaaaaaacatgtcggcaagagaagaatcagtcccgtaggagcaggcaaacctctccttccttccggtggctcccctaggacctgccggagagtggagagtccggtgggggggtccccaagcccagggtggacgaggaaaaggtcaggaaatagaggattgtcctgagccctcctggccatgggggccgacccagtgggcactgaggcacttgtgggcaaaggctggaggcccatgcccctttgtggggggcgagagctgtcctgggagggccaggtggggagggagggggtgctgagggctgcttagggagaaaccagccactcagttggtctctgaggcaaggctcctggggcggggctgaggggggatagctgggggagtggggaccccactgatagcctcaggggctcctccctctgctgtggcagcccccaggtccacctgtgcagggttactcaaagagactgggctgggggaggctggacctggggaggccgggcttggggaggctggtgaacgcccgctttggcgcccggcaggctgagggggtggtgggtgtaaacggggtgcactgtgggggct

SEQ ID NO: 7025 - DNA, 167 bp, Homo sapiens
aagcttgcggccgcggttttttttttttttttcggcttcccttttttctatatctttcccttaaccttaaaaaaatcagggttaatatttaaatgttgcaaataacaaaaacctaaatgggattttggcctacgggtttaagggacggggaaaataagggggccaat

SEQ ID NO: 7026 - DNA, 658 bp, Homo sapiens
tcggcacgaggatagaacgttaaagtgtgaaggaaccatcaggacagctcaagaagccgaaaccaagcaaatcagatggcccagggccacacagggaaggagtggaggggtccctgcgggagtgctgccccttccaggcctcctctgtcaccagaggagctggtcctgctgcttacagtcatattaaacctttggatggggtatgtaaggacactttcccctggaaaaatgctacgtcactcactttatatcctggccttaggccaactgagccttcaccccaccctccctgcctaagtcacctcaccaagcatcctctggtactgacgacgatgcttttggcctggttaccaagctttcctgaccacctgatggtagggcccctccacatgggctattcatcctcccagaagcaggtcctccagtgactgatctgcactaatgtgggcaaacagagggcatcctcctcctctctctgcttcttttctttgcaaaattagtgggacaaataggtacaagttgcatgaaaatgagatacagttcttcatttgccatccacaccaggagcaccaggtcccggagcccagctgtgcattagatgttgtctctgcagcacaaggtaggaggctgcaggatgtacctgagaaacgcaatcgca

SEQ ID NO: 7027 - DNA, 408 bp, Homo sapiens
ttttcacttcatttcatcaattcattctttattcaacatacacttgttgatgcccggctctgtgcccgacaagatggtagctgtggagactgatctgaaaaagcaaccttcgtgacaggtggaagttggatgggaacaacccacccagccaattaggttcctcagttgcatgacaccaaggagctgctgtctgggaaatgcacttattacgagagggacaaagtgtgactgagccacaggctcacctcagccagtcaaaaggacttgggcactgcctcattcaagccaccttggagcagacgtggctacgctcccagcagccctgtacccatcggccactgaagatctcagctctcgtcagccttgcaaagcttgctgcatctgagtcttgggctcccggtccactgc

SEQ ID NO: 7028 - DNA, 98 bp, Homo sapiens
taatgtaacctggagcttttatacactacatttcttttttattatgaagaatgggatacctccaggttccagtaaaattcttctgaccgaaaccaatg

SEQ ID NO: 7029 - DNA, 394 bp, Homo sapiens
tctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcac

SEQ ID NO: 7030 - DNA, 566 bp, Homo sapiens
agtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaaggcataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatag

SEQ ID NO: 7031 - DNA, 513 bp, Homo sapiens
cccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttg

SEQ ID NO: 7032 - DNA, 554 bp, Homo sapiens
cagatcatccattttaactttgcattttccccttacattgcgttgtcttacatggcacattctttcttctaccacggtatctttggccgtgcttgtacctgatgttaagatgcctttccttttcctctgcatctgttttgttttaggaatgatttgtttgcaagaatagttcccaccccaacaaacttaagtaaaagcttatgttatttgataggacagggatttattatagagtaaaaatgaaggaaagtacagtcacctgagactgaaaacagccactcagtgaccaaaacagctcttctcacaccttttttgaggctgcttgtttggttgtttcttatttctgcatctctattcttttttaaaattttttctggtcgagcgcagtggctcatgcctgtaatcccagcactttgggaggccgaggcgtgtggatcacatggtcaagagatcgagaccattctggctaacacagtgaaaccccgtctctgctaaaaatacaaaaaaaatattagccgggcatggtggcaggcacctgtagtctcagctactcg

SEQ ID NO: 7033 - DNA, 557 bp, Homo sapiens
gttaaaaggaattcatgcatagaaagagataatagactatctgcagttcattagtagttgtattcagattgggaaaacaaagtgttaattgttgaaagttgtttagggactgctgggtcttggagtcagcacctgggtttgcattccttctctgcaattttctgtatatgatctcaggcaagttacttgaccactctaaaccctggcttcctcatctatataatatagatgatagcatctgcctcacagggttatcatgagaattggatgcagatgtgtacaaactgttccgtgaggcatcaggcactcagtcagtcactaatactatcagcttacaaagctgaggattcaatcatccagtcattagcaatctgttgttgggatgtgccagtgttatctagcaaccagttggaatctgatagcaatcagaaattagataggttattcctggattaaacagtatattcatataagtgattgcttggatcctcatcagaagctgctattgaaaaatagtgatatggctggccgggcatggtggctcatgggtgtaatcc

SEQ ID NO: 7034 - DNA, 342 bp, Homo sapiens
gcccagtgttctttctgtatacttggtctctgtggcttatttcttttctcagtctcttatcccagctgatgagaaatagccacaggtgtggaggggctggccccccttcagggttttatgccttgggcttaggttgtaatttggcagggcggccttccaccctttggcacagagctgggtgttcgcacgaccacaaggggttttaggccctggaccccggcatgttccaagactctatattatgtcagactagcaagccctgcgtcggcttttccccaacatggaacgctgttctaaaagcacccatgattcttttttttcttttttttctttttttttttt

SEQ ID NO: 7035 - DNA, 373 bp, Homo sapiens; identical to SEQ ID NO: 2103

SEQ ID NO: 7036 - DNA, 60 bp, Homo sapiens
tgcaccgctcactaaactgccgatcaaatgtttcctagatttcaaagcgggaggctcctt

SEQ ID NO: 7037 - DNA, 464 bp, Homo sapiens
tagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccaaaaagtgtggtaaggggtgttttccttacatgatattgttacatgtctacatgatcttgttacatgtagtaaacaagatgttcatgcctaattgaattct

SEQ ID NO: 7038 - DNA, 533 bp, Homo sapiens
gacagagggggagtttcgctcttgttgctcaggctggagtgcaatggtgtgatctcggctcactgcaacctccgcctcccgggttcaagcgattctcctgcctcagcctctcgagtagctgagattacaggcatgatccgttgctcccagccacccatgtattcctgattgaaaaaatttgcttatgtcttagttctacagctgaccccctttcgctattttcaaggtcaatagctgtgtgttcacacttctgcattttataaatgttactgtgattttcttctaaggaaagattaaatgtcaggaatcagtggcatcagaaccttgcaaaagaagtttctttagcccaggcctgtgaaagatgcttctgtaattttcaaggataggggtgataaagaccaagccttcccattagcccttccaggcccccatgtaagaattcaggcacaccttctcactcatctcagaccttctcaaggtaacttggtgaaaatttccctgctctgagcccagtgagcctccctgcaacttgg

SEQ ID NO: 7039 - DNA, 472 bp, Homo sapiens
gagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagtcagaaaagttctgtg

SEQ ID NO: 7040 - DNA, 147 bp, Homo sapiens
atctattgagcttgtttcttgtaaacttttctttatcttataaaggcatatctcgcttttgtatcgacctgttccttaaaaaatgtatttgataaaacaggctaaaattcatttgagtattgaaaagaattcttttttttttttaaa

SEQ ID NO: 7041 - DNA, 58 bp, Homo sapiens
gataaggaatggagtttgacccaaccccaagatatgccctggggatattggttttctc

SEQ ID NO: 7042 - DNA, 524 bp, Homo sapiens
atcttctaaaaactaactggtatggaaatattacagtcctgtaattctttcttctaggtcatattgaacattccagatacctatcattactcgatgctgttgataacagcaagatggctttgaactcaagactaagaaagcactgtgcatcaccttgaccctggggaccttcctcgtgggagctgcgctggccgctggcctactctggaagttcagtaagtgcagggagcctcgatcccaccatgtgctcctgcagtccccagtgctctgagccagaccctgctctctgggctattgagacctctggaggccctccatgaggttcctctcttacataacgaggctgtctctcttcccttctcttgtttagctatgagattgacacatcatggggaaagcatttaaaatgtacccagtgctttggggtgcttggtgccacccagcactgtgagcacaggttcttctaccttggggccacacccagttacctgtatctcactgcacagcagtggctgttggggacc

SEQ ID NO: 7043 - DNA, 560 bp, Homo sapiens
gacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgaactggcaggtctaatg

SEQ ID NO: 7044 - DNA, 124 bp, Homo sapiens
tacggctgcgagaagacgacagaagggtacggctgcgagaagacgacagaagggtacggctgcgagaggacgacagaagggtacggctgcgagaagacgacagaagggtacggctgcgagaaga

SEQ ID NO: 7045 - DNA, 538 bp, Homo sapiens
cacagtggaagactacctacattagctatgcatttcaagagctcacacttatattgtggcatatagtcaacatggaagtagaccagctctgctgatttgaaatttagattttttaaattatgtactggggacaggtttttgtcgcggtacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgt

SEQ ID NO: 7046 - DNA, 483 bp, Homo sapiens
gggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctc

SEQ ID NO: 7047 - DNA, 664 bp, Homo sapiens
tgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcgaaaacatcctcggaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctg

SEQ ID NO: 7048 - DNA, 504 bp, Homo sapiens
gggaggatggaagaggctgattctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatg

SEQ ID NO: 7049 - DNA, 72 bp, Homo sapiens
attcattttttagcaggtagtatggcattgtggttaagaatttacatttgtgaacatttaccagctgatgac

SEQ ID NO: 7050 - DNA, 535 bp, Homo sapiens
atcacataaacatggacttgaaaaattaggcttttcataaaacacatcacatgtcattgactgctttttagaaatacacttccaaggcagtacgtctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccacttatagtggttctttatttaaggaataactcagctgggtgcagtggctcacgcctgttatcccagcactttgagaggctgaggcaagcagatcacttg

SEQ ID NO: 7051 - DNA, 117 bp, Homo sapiens
gggggggcgcccggaaaccccaaggcccaaacggctctcaaatccggggactgcggataaatggccttaggccgcgggcagcgaaatgttgcgttccggtgtgggtgtgggtgtgcc

SEQ ID NO: 7052 - DNA, 544 bp, Homo sapiens
acagaagggagggaattttctacacacattaggcaaatgtatgcttttcatcctctgggcttacctctctcctctgcaatcctggaagcattgtgcatagttctttcattgtaagccgctatttaaattcccacaatgcaaaactgttagaccagtaattgtgctactgaaattgtcacaaaacgttattccttgatttggtttttaaattttgcttttgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggactta

SEQ ID NO: 7053 - DNA, 646 bp, Homo sapiens
acatttatatttaattaaacatgaggtccatttagattttgggttgattcattcatctgtgattactgagcatttgccatgtgccagtcaatcagtattaggcaccagagttaccacagtgagcaagagagacatggaccccttctgcaagatgcctagacaattaaatggccaatgaaactaaagtgaggtaagggttctgatgtgaaaagctgagggtgtgatgaggacaagtggcagaaagttcacctggcttggtggaagggaaggtcagagaagacctcttagaggactcagtaatgtccattgaggattttaggttgaagggaatgtttgaagtttgagggcccttttgaggaccaccaagaacttcactgtgctgtaggatattgagcaggaggtgaagctagagagatgtgtaggccacattgcagagtttgaacttggggcaatgggaagccattgaagggttttaaacaacccaagtggtgcattcttctgtaaatgttagagagatcagtggctgccctgcacatcaaaggggagaacgattggagacaggcagattagatggaaggacggagttgtactccaagccaaagatgatggagagtgaattaagttagtgcaatgggaccaagtctag

SEQ ID NO: 7054 - DNA, 511 bp, Homo sapiens
aaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatggaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacat

SEQ ID NO: 7055 - DNA, 557 bp, Homo sapiens
acagaagggatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattaaaagtatatttc

SEQ ID NO: 7056 - DNA, 569 bp, Homo sapiens
agaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatacctgtctaacctgctctttctctttggtgccccttatctcaccccttcctt

SEQ ID NO: 7057 - DNA, 599 bp, Homo sapiens
acagaagggacatgaccaccaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggctcttactaaaaatggacgcctggcaaccaagtatcataccgttccactgccaccaaaaggaaaggttttaatccattggatgacgctttgtcaaacac

SEQ ID NO: 7058 - DNA, 375 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacataagggtacggctgcgagaagacgacagaagggtacggctgcgagaagacgacagaagggtacggctgcgagaagacgacagaagggggctcacgcttgtaatcccagcac

SEQ ID NO: 7059 - DNA, 610 bp, Homo sapiens
acgaagggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttacaggttttggagcaagagcttgcaggaagcccgcacccagcttccttctgac

SEQ ID NO: 7060 - DNA, 382 bp, Homo sapiens
gacagaagggtggttgaaatgctctgatggaagactcccattataccagcatcagcagtgtggaggggccagccagtaaagtgatctctctctggttggaatatgtagagaaaaggagacaacaccgtcgcccagaagtggaggttgccatattacttgcacaaacctcatgccgttaggtcttcagccacagccgatatttgcagagatgtatctccagcgatctatctccagagatggaacctggagaaatgaccaaacttgacacagccttcaatggttggataaatagctcattaacccaattagtagagaaagctgtgcaatccaagcactagcactgtttgtaggagttattaatggataacacaatgtattatta

SEQ ID NO: 7061 - DNA, 554 bp, Homo sapiens
aattatcttattctctctgaaattctgtgtaagtgttagttacacgaagttaccttgaaaacactgcctcgcatttattcagtactcaccatgttcggtgcttgatatatatctcatccctataacaacactaaaaagtaatcttattagaaggcaggtattttatttattttattttatgttattttattttatttttttcagacagaatcttgctctgttgcccaggctgaaatgcagcggcatgatcacggctcactgcagtcttgacctcccaggctcaagagatcctcccacctcagcctcctaagtaggtgggacaacaggcacatgtcaccacacccagctaacttttgtattttcttgtagagacaggattttgcagtgttgcccaggctgatctcgaactgctgggctcaagcgatccgccagccttggcccctcaaagggctggaattgcaggcctgagccacatgcctggtctggtattttattttaaatcataatcccttgcaaaacatcctgcatggtagatatataacaaatgtttactg

SEQ ID NO: 7062 - DNA, 489 bp, Homo sapiens
gacagaggggtaaatcatggtcagttcttatgggccttgtaagccaagttaagaacattcaagatgaaagaacatgaggaggttgacagttcagatggacctccctggcagccgagtctgtggagtgaagggagggaagttaaaaacattcgagatgaaagaatgtgaggaagtttgcagttcagatggacctccgtggcatctgagtctgtggagtgaagggagggcacgcttggaggcggggccttcaggccttcctgcgcttgtgtctgtgagataaaggcctgaactaaggtaacagggaaggagaaaatgaaactgaaggaggtaaactggaatttggagactgacgaggagagaaaggaaagcattccagggaaaccccagttttttgcttggctactttgggtaggtgatggtgtcattaaccagaatcaaaaatgtcagtggtagattagatttgagtggggaaataaaaagttctctttg

SEQ ID NO: 7063 - DNA, 609 bp, Homo sapiens
acagaagggggcgcggctctgggtccgtctcgccgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaaataaaaatcttaaagctggtcacaagaatggcaaacagaagataatgaagcgaaaatggcctggccctggaacaaaggatcaaatgctttgctgaggaacagcggctcacagga

SEQ ID NO: 7064 - DNA, 520 bp, Homo sapiens
ggagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaatgtgtatgcagatggaaaggaagtggaagacaggcagagtgcaccgtatcgagggagaacttcgattctgcgggatggcatcactgcagggaaggctgctctccgaaacacaacgtcacagcctctgacagt

SEQ ID NO: 7065 - DNA, 538 bp, Homo sapiens
acagaagggtagggagcattctcctcctcctctgtgcacggttgcggtggaactctgtgggcatccctctgagcctttgctggtgctctgcacacgctattaattacatgaaaaatattattacagcatttttaaaaacctatcaagcagctaatattttccgcccacccacatttaccacaagcaattttgcttccacttacctgcctgccactcatttcattagtttaagagaatgttcgtttgtgcttagagaccagtagatttcgagatggcacagagccacagtcattccacctgaaaggaatgtgtgcagaagcaaatataagagaagcagttgtgtcattgctcctgttagtaagcagtggatttcttgtaaagtttttttttgttcgtttgtttgtttttttaaaaaaaggaagaaaaaccggccaggcatggtggctctagcctgtaatcccagcactttgggaggctgaggcaggtggattacctgaggtcaggagttcgagaccagcctggccaatatggtgaaacc

SEQ ID NO: 7066 - DNA, 536 bp, Homo sapiens
gatccccaagaggcggccgttaaggacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatat

SEQ ID NO: 7067 - DNA, 459 bp, Homo sapiens
atgaaggagaggtagatttctgagtgattcaggtttaaccagctgggtatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatgggggctggatttcagattttgttacagaattagacag

SEQ ID NO: 7068 - DNA, 552 bp, Homo sapiens
ggattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctg

SEQ ID NO: 7069 - DNA, 471 bp, Homo sapiens
ggacacactctgcgtcctcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtag

SEQ ID NO: 7070 - DNA, 517 bp, Homo sapiens
ggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagagtacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggct

SEQ ID NO: 7071 - DNA, 556 bp, Homo sapiens
acagaagggggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaagaatgtaattatatctagtgctgcaga

SEQ ID NO: 7072 - DNA, 490 bp, Homo sapiens
gacagaagggactggagtacagtggtgcgatcatggctcaccacaacctccgcctcccaggttcaagggattcccctgcctcagcctccctagaggcacgcgccaccacacccggctaatttttgtatttttagtagaaatggggtttcaccatgttggtcaggctggtctcaaactcctgacctcatgatccgcccgccttggcctcccaaagttctgggattacaggcatgagccactgtgctcggccttcacagttttttttttttaagtctattgctaatgcaacagctatgtagcatgcttaagccaaaacattgataacaatttggcaaataaacagcatgccagtgtgcaagccaagcctctagactctcaaacttttattctgctaaatttccaccgtagtttttagtcctaggaatatatatatcttaggctaaaacttcaaaatcatgggtgaatttttggatggcctaacttatttaag

SEQ ID NO: 7073 - DNA, 557 bp, Homo sapiens
acagaagggattattccagctgcctcccagattaatgcataaagccaaggaactaccccgctccctacgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccccccctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctct

SEQ ID NO: 7074 - DNA, 399 bp, Homo sapiens
gtactggaaatgcagcattgtttgaatatctattgtgtgtgagttgctttctaaatgtaccttaatccttacaaacctggaggaaaaaaatgtttttgaccctgttttacaagttcgtgaactgaaatttacataggtattttttgtatgcccaagccatactgccaatgccagaactagaacttgaacccaagttgtgactctcctttaccacttgatcaggagtttgctgatttagccaagtaacttgtaagatcttcacatgctttcttttagtgggattgcccagcaaagtgcttatcaggtgatgatcccagtgaagtatgtcacagttatgcagtaacttaaggctgctgtaatacggagatacattgaagttcattagtaacttttcagtga

SEQ ID NO: 7075 - DNA, 462 bp, Homo sapiens
acagaagggtagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaag

SEQ ID NO: 7076 - DNA, 564 bp, Homo sapiens
  misc_feature 511: n = A,T,C or G
aaaagctgcctgtgacttgagaaattgctcttactccctccttttctgttccttgtcagtgccctgaagtaaggagttgtagagttgggctcttctctgctgtggctgggcctgtgggaggcagctcatgagcctgactgccctagtgaatttcttcccaggtgtagtttttcaggtcacaattgaagcagtactggaaatgactctttgctcctaagaatcttcgagacaaataaggacttgggttaaaaaaacaaaacaaaacaagactgtttctattccattttattaattcagcagaagtcatactgaagacttgttcttctcctgttctcagctgcctgtctttttgccttttgcctctggttagcccatgtatgtgccaagtgtggcagtaaaggctgagtagtttttgaccacttactatgtgccaggcactgtgctaagatctctctgtacattgccacattcttcaatggcagtttgaaataagttctatcattattatccncattttaaagatgggaaaacagactgcaagaacttaagttgttacccaaggtc

SEQ ID NO: 7077 - DNA, 99 bp, Homo sapiens
gcttactggaaggagttaagggagcatgtgtggatgtggctgtggctgtgtgtgtgtctgtgtgtctgtgtgtatgtacagtttacatgaatgttcctc

SEQ ID NO: 7078 - DNA, 88 bp, Homo sapiens
aagctgtctggttcaagcaggagcttcacttacatctgactgttggtgctagttgtcagccaggccatgtggactcggagttatgact

SEQ ID NO: 7079 - DNA, 70 bp, Homo sapiens
ttgcagtcaggcttcatacgctattgtcctgcccgttagagcagccagcgggtacagaatggattttgga

SEQ ID NO: 7080 - DNA, 533 bp, Homo sapiens
agatcatcctatgggggcaagaaaagggtcaggctactctcgagggaagcgcgtcagctgattggcaatatgctgacggtggggggagtagataggggaggcagatgcagttggtgggtatggctggtacttccaaatacagccaaagtttatgcacttaacatgtattaggcacagcgctaattactataagtgattgatttgacttccccacatctttatgaagttgagtatgttattcctttccctcttttatttacttttcgatttatttttatttttttagacacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtga

SEQ ID NO: 7081 - DNA, 549 bp, Homo sapiens
tatccagtagtgggattgctggattggtagttctacttttagttctttaagaaatctccatactgttttccatagtggtactaatttacattcccaccagcagtgtaacagtgttccctttcattacatccacaccaacatctattgttttttgactttttaattatgagtcttcattattaatagagttcattccaaggtcttttttatttattgttttgatttgtgccctcaagctgtaatggcagacaggtaaagactgcaaatccttaaagaagaaaacaaatggatattaaaacagaaaaaagagaaaatgctaaattgtgaagaaggttaaaagacaagagaggggccgggcacggtggctcatgcctgtaatcctagcactttgggaggccaaggcgggtggatcacctgagatcaggggttcaagaccagcctggtgaaacattgtttctactaaaaatacaaaaattagctgggtgtggtggtggacacgtataatcctagttacttaggaggctgaggcaggagaatctcttgaacccg

SEQ ID NO: 7082 - DNA, 459 bp, Homo sapiens
atgtattgaaaacttggccattttaccccattcctatgaatgaaaactatttggtgaatcagaggatagtctgaattgggatatgaaggccagtataagtgtcagttagcaaagtcagctctagtttagttttttttttttttcttttaaggcgtacctttactaaaagtatagctttgggaaccttgtaccattttaaaaacttttaaagggttgacagcttttggcaaattgactaatacaaaaaactaaccttgggttcatgttttcaatgtctaaatgaaaaatgggaaaataaaaaagctaaaaatgaaatgggatttcatgtgcttctcctttttagctcttataataaattgaacaaatttgatatttggggtaaatccactcaggcaaagtgacaaaggcttggttgtcatttaccctttagggtcttagtggagttaatgaaaactgcaa

SEQ ID NO: 7083 - DNA, 434 bp, Homo sapiens
attttcaactttgaattgtaatcagaaagaaaatatattttaaccattgtttagtgcttctgttatatattgaaaacttcagtcttaattttttagttacattgttgatagggcattatataaatatacttctatagtcattgtaggaaatgtcttttataaggaaatatttcttctacctctgaattacacagttttgtatttacttggactgcatggcaacattcaaaaaacactttgaataacagataaaaatgacattttctaaagctctaggtttgctagatgcatgaagtctcagcaaagtataaatttgtaaatatttcattgtaaaatatcataaattgactccttcaagtgttcagtagtacaataggtaatcaataattggcctcttgggactgactgtaacgttttggtgtttgtatgttttg

SEQ ID NO: 7084 - DNA, 318 bp, Homo sapiens
atcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactgggagggctgctgaaagacatccgggaactggtgaccaaaaatcctttcacactgagcgacagttccaatcctggacagacggagagactacaggagttt

SEQ ID NO: 7085 - DNA, 557 bp, Homo sapiens
gaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagaccatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcaccca

SEQ ID NO: 7086 - DNA, 530 bp, Homo sapiens
acagaagggacaaccatcttaatgaacttcctgtacctgctgggaaaagttctgaacaactatatctgggatacacagaaaagtatggaagaagagaaagaaaagcctaaattgtaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagtcttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaa

SEQ ID NO: 7087 - DNA, 434 bp, Homo sapiens
gggtcggggagtagaatagtgtgctcttatcagcatccttgtacaggtctttttatccttgtacaggtcttttcatccttgtacaggtcttttgttgagcacatgggaacatttttgttggatctatgcccagaagtataaatgctgagcagtagggtatgttcatgttcaactttagtaaattatctcaaaccattttccaaaatggttgtaccagtcgaaagtcccaccagcagtgtaagagaatttcagttgctctacatcctcaccacacatttgtctttttaatgttcatgagggatattagttggaagttttctgttttatactgtctttggctagttttgatatcagggtaatactgatcttataaaatgaattgagaagggtcccctgcccttttctcaaaaagattatgcttttaaaaaatgatg

SEQ ID NO: 7088 - DNA, 538 bp, Homo sapiens
acagaagggaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttg

SEQ ID NO: 7089 - DNA, 520 bp, Homo sapiens
tgtctgtaaacaatgggtataataatagtttttttgtgggaaaaaaataagattcgacaaaaaattatttggaacagtgatgtgattcggctgtgtcccctcccaaatcgcatcttgaattgtagcttccacaattcccatgtgtcatgagagagacccggtggaagataattgaatcatgggggcatgtctttcccatgctgttcttgtgatagtgaataagtctcacgagatctgatggttttataaagagcagtttccctgcacaagttctcttttcttgtctgctgccatgtgagatgtgtctttcaacttctgccatgattatgaggcctccccagccacatggaactgtgaatgcattaaacctcttttccttatacattaccctgtctcaggtatgcctttatcagcagcatgaaaacagactaatacagacagtatctagtgcacagtaagagctcagttaatattgaattaaaaatgcaagtaaaatgatgctacaccaattgtgttggca

SEQ ID NO: 7090 - DNA, 508 bp, Homo sapiens
aatccctacgcgtccctttgggtttagcacgatgagctcaatcggcactgggtatgacccgtcagcctctacattctctcctgacggaagagtttttcaagttgaatatgctatgaagactgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatac

SEQ ID NO: 7091 - DNA, 664 bp, Homo sapiens
acagaggggtcttgctctatcaaccaggctggagtgcattggtgtgatcatagctcaccataacgccaaactcctgggccgaagcgacctgtgtgtgccatcatgcccagctaatttttgatattttttttagcgatggatctccctctgttgcccagactggtcttgaactcctgagctcaagcaatcctcctgccttggcctctcaagctactgggaccacaggtgtgagacactgagctcggcccatcaacatttaaaaaatatccaccacttgtggggactgtgttaggtacagggattagagggtagaaggatacaaagatggataagctacatccctgctttcaatgcacctagtctcctcagagagacagtcacacaaagagatgattatatcgtatgatgtggaaagtacaataatggcgcatgtgcagttatagaagaggactgaggagaggcgggagttaggcacagcttctgggagttcagacctctgaactgtgcctcaaagaaccagtaaaagtcagtaagacaggcagggcactgtggctcacgcctgtaatcccagcactttgggaggccgaggtgggtggattgcttaaggtcaggagtttgagaccagcctgaccaacatggtgaaaccctatctctactaaaaata

SEQ ID NO: 7092 - DNA, 535 bp, Homo sapiens
acagaaggggtggcacgatctcggctcaccgcaacctccgcctcccaggttcaagcgattctcctgcctcagcctcctgagtagctgggattacaggtgcatgccaccacacccagctaatttttgtatttttagtaaagacagggtttcaccatgttggccaggatggtctcgatctcttgacctcatgatccgccctcctcggcctcccaaagtgctcagattacaggcgtgagccactgcgcccagcccatcacccaacacttctaatctactgaaaactgtgcctcagtgagacactatatgtgaaagtgctttaaaaattatatctgtatcttattcttgtaatcaagatcatgtctgacataaacataaatattggctcttctaaataaagagttaaatatacagtatacactttactacatttacattattttggttactcagagcccccccccccacacacacacctttttttgcttatattctaatctgactttgttttagattcatgattcttaattttcaaact

SEQ ID NO: 7093 - DNA, 208 bp, Homo sapiens
ggtccctgcattgcgcgcgactcggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgaca

SEQ ID NO: 7094 - DNA, 422 bp, Homo sapiens
ggtactcttgtggcaaaactgctggcaagtgtaccctttctgcagaaagtaaaaatggccttgctgaggaaattaaatttatgttcaagtgctatcctttacagcaccagggaacaagcatttctaacaatagcttatatttactacttaatgtttgatttacttttattgcaaataaggtcaaatcaaacatttacaaactggtacaataatacttttttgtaattagatatacaccaattcatactgacaatataacaaataattgtaatattcagttctagtattctactcaccacaaatccaacatttatttttccttctctattcttcctgctgaaaatgttaatctcttcagacaattatttgctatgaattcaaataactgctccaatctaataattgttcatataattcatctt

SEQ ID NO: 7095 - DNA, 364 bp, Homo sapiens
  misc_feature 204: n = A,T,C or G
acagaagggatcatgcatccgcccagcctccaaattaatccacattgtagataagttctatccagagggaggttgcttaacatatactgcaggggcctttgcctgtaggttgccacataggtaggaaacccttaatactcatgcatttgccctgagtgatgtgcctgcccttagctatgtgcgtctctgccagacgctgtgcgntgtgtaggtcagaaagagaagaatccgtacagtctgtgtctcgtgagcagctgtcacaggtttacttgaaccagagagactaaaaagtttgttcatgtaatatttgtccttggggccaaaatggcatcatctgcagttggaattctggaagtgaggaaag

SEQ ID NO: 7096 - DNA, 504 bp, Homo sapiens
gacagaaggagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctcccaacctttattaaacatcgacttcctgcacccttttcttgaaaatgattacctatgttaggctttctgc

SEQ ID NO: 7097 - DNA, 297 bp, Homo sapiens
tctcgctgagctcgaggaggtggcgcgatggagggactggaagataatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaaccaccaaagaaaccatctaattggagaaggaaacatgaagaattcattgctacc

SEQ ID NO: 7098 - DNA, 83 bp, Homo sapiens
attttttactgtctcctgaagaatttaacacaaacatggatatcagaccaaatcatacaatttatatcaacaatatgaatgac

SEQ ID NO: 7099 - DNA, 543 bp, Homo sapiens
gacagaagggtattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatacctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatccca

SEQ ID NO: 7100 - DNA, 312 bp, Homo sapiens
gggaaaaaaaaaaaaaaaaaaaaaaaaaaatgggaggggcccattgggggggaaaacccctttaaaaatttttttgttaacaaaaaagggttttggataaaaaaaattaacctgaaaaattcttttttgggccctccctttttaccatggttaaccaaatggggggggggcaatttttaaagtttaaaaaaaaatttggcctttgaaacaccttccctttttttgaacaccgggtgggaatggccaaaaattttttttcccctaaggaattttgaaggaattaaattagggtggtttgaaaaaaagggggcc

SEQ ID NO: 7101 - DNA, 427 bp, Homo sapiens
gtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggt

SEQ ID NO: 7102 - DNA, 264 bp, Homo sapiens
gagacagatcactcctggaggctggggatggtaggattgctggggatttttttttttttaaacagggtctcactttgttgcccaggctaaagggcaatggggcaatcacagttaattgaagcctaaacctcctgggttaaagcaatcctcctacctaaccctccggggtagctagcaccttggcttgccccaccatgccctatttttttttttaaaaacggggttttgtttttttccccaggggggttttaaacggggctaaag

SEQ ID NO: 7103 - DNA, 520 bp, Homo sapiens
aggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcgcgtgataagacaaaagactgcaccaactcaccctgacacagatacatagtcactgggagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgc

SEQ ID NO: 7104 - DNA, 643 bp, Homo sapiens
gacagaagggcccctagcattccaggaggcgaaagctatgcactgcgcagaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttagagagtatgatggaaggtctgatcttcatgttggaataactaacacaaatgtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaaggtagacagcaactggacaagggtgaattacggagaagtacgtggtcccgcggacaaggctggcatccaagttcatcacactctaccgggcgatacgggagcatggcttctacgtcactgactg

SEQ ID NO: 7105 - DNA, 568 bp, Homo sapiens
  misc_feature 476: n = A,T,C or G
ggagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagcccgctaggtgagaggaaaagctctttacttccgcccctggcagggacttctgggttatgggagaaaccagagatgggaatgaggaanatatgaactacagcagaagcccctgggcagctgtgatggagcccctgacattactcttcttgcatctgtcctgccttctttccctctgcgag

SEQ ID NO: 7106 - DNA, 577 bp, Homo sapiens
gacagaagggagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaattacagc

SEQ ID NO: 7107 - DNA, 453 bp, Homo sapiens
tttttttttttttttttttttctttaccaaaaaaaaaacaggggaccagggggcccttttttttttttaaaacccccttccttggtgttccccgggaaaaaaaggggcaaattccccccgggagggaaaacaaaacatttttaaaacccccttttttaaaagggaaaaatggggggaaatttaaatatgggttgtaaatccaaataaaaattttttcaaagggaccctttttccaaagcccgggaaacaaacttttttaaccccctttaactcccaaaaggatccaaactttccccccaggggttttacccccctttccccaaaaaaaaaaatggaccccctgccccccccttttaaacggtcccaaacccaaattttaacctttaaccccccccattttgggacccgggggacccccaggacccaaaagcgggttctccccggggcccttga

SEQ ID NO: 7108 - DNA, 690 bp, Homo sapiens
ccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctatgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaaatgtatatttttgc

SEQ ID NO: 7109 - DNA, 491 bp, Homo sapiens
tggtacgcctgcaggtaccggtccggaattcccgggtcgactactactactactttctcggccgcgtcgacagattttgttttttcctgttggtgtcccagggactctgtcagtgccttcagcccaccagcaggagcttggagtttggggagtggggatgagtccgtcaagcacaactgttctctgcgtggaaccaaagaagcaaggagctaggacccccagtcctgccccccaggagcacaagcagggtcccctcagtcaaggcagtgggatgggcggctgaggaacggggcaggccaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctt

SEQ ID NO: 7110 - DNA, 317 bp, Homo sapiens
aagcttgcggccgcaaacctttttttttttttttttggaaaaaatccatttttttttttattttcccccccacctttaccttattaaaccccaaggaggaggaggggggtaaggaaaaaaataacctgaagaccccaattaggggtagcccccttgggaaaaaggggtcaaagcccaaagaatggaaggggttaagcttaaaactaaaaaccagggggggccatttttcctttaaacattttcccttgtaaaacttttttgaaacggccaacctaagcccttgaggggaaatttccaaggcgaaaattttggttttt

SEQ ID NO: 7111 - DNA, 125 bp, Homo sapiens
ttatttgaagaaagccactttaatgtattctggaggaatgtcctaaactaacaaataaaacgattagatctaaggagttgttttcattctccaggcaggaacccttagtgtccctaagtagggtg

SEQ ID NO: 7112 - DNA, 176 bp, Homo sapiens
aattttaaagatacatgaaaagggttttatttatttaacaaacagacaattgaacaaacaaacaatggaagcaagtcatttgccaaaaggaacacagagggtcatgatgatctactccaccaaggatttcagggttcccagacgcctagttttctgtctagttctggaagatgtta

SEQ ID NO: 7113 - DNA, 524 bp, Homo sapiens
gaaaagcagtggtgttttaccactctgcggagaaagctaaggttgctaaccaaacaaaataactttacactgacaatgccaatttttacatttctttcagaacaagggacactcaaactaccagaggtaagattaacattttaaatattttttataacctttgcatttcaagttgtttgctaacttaatcaggcttgggcttttacactgttaaatgtgccttttaaaataaatagaaataaacagaaacagagggaacaaccaagtgattgtgaacaaaatgcaaaagttaaatccaaggaatgttcactgtcactgtccgaaggtcttaagtagagaaaaaatgtgaatatttaatcaaagactgtgtatgaaatgggactgtaagtacagagggaagggtggcccttatcgccagaagttggtagatgcgtccccgtcatgaaatgttgtgtcactgcccgacatttgccgaattactgaaattccgtagaattagtgcaaattctaacgttgttcatcta

SEQ ID NO: 7114 - DNA, 452 bp, Homo sapiens
acagaaggggtcaatgagagctattatttttgttgttattgtgtttatgattacaagagaccataagagacaaggaatcaaaagctgtgtttctccattatcagattatcaagggaacatcagtgaagaatatacataagacctcatgtaaggaacaaattaagcatgattgtgtctgtattctagcagtttatcatctacaacatacaattatttgagagaggaggcgtaggaagagggagcgagggagcgagaacatgcatataggtaaatagaccagtatacatgctattctgttctgttttgtaagcatgttttctggaaaatgactgttagacagcagatgtagcactcacatttatgagttttcatttcagcagtttactgaagtgaaatttagagaaatgggataaagtctctaacatttctagtaagttctatcaatcagaaaa

SEQ ID NO: 7115 - DNA, 219 bp, Homo sapiens
tacggctgcgagaagacgacagaagggtacggctgcgagaagacgacagaaggggccgggggggacataatagaggctggaaatgtgatccccacctgaaatgccagttcccaattacatccctacagcttggatggagagcatagatctttggtggatcaatagctgtgtgtcatgaccgcagagagctctacagcagatccagcaatttatggtcaa

SEQ ID NO: 7116 - DNA, 556 bp, Homo sapiens
acaaaaaactcatggacacaacagacactgggatcttcttgaaggtggaggttgggaggaaggagaggatcagaaagaataactattgagtactaggattagtacctgggtgatgaaataatctgtaaatgaaaccccaatgacaccaatttacctacataacaaatgtacacctgtacccctgaacctaaaataaaagttaaaattaaaaaaaaaacctagctattatggaaaaaagaaagtcattgtaaccccttctgttagatatacttttaaaacgttaaagtaacttttcacttgtaaatacaatgtgtttttgataaacacctgtcagagcactgtgttgctatatgtggcatccagactcttagcataacctctcatgatctatggcagctttaggtcagtcttaaaaaaaatgttgaaagggccaggcacagtggctcatgcctgtaatcccagcactttgggaggccgaggtgggtggatcacctgaggtcaggagtttgagaccagcctgaccaacaaggtgaaaccccatctctactaaaaatac

SEQ ID NO: 7117 - DNA, 93 bp, Homo sapiens
ggcagaagcttatgggtatagttaataaagtgtcttctaaccacattggctgtttagtacatgggtgtttcaatgcctccattcctaaacctg

SEQ ID NO: 7118 - DNA, 514 bp, Homo sapiens
agaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatctactgctgaataaagaccgatgaagaagtttgagtagatgtacaaatcaagtaatggtttgaacacctttaataatatgcctaatctgttcaattgtttt

SEQ ID NO: 7119 - DNA, 436 bp, Homo sapiens
aacttcagaaaatatcagcaacaattctgaaaacattcaagagaatacataatttatggagctaggagaaaatacataagactggaaatcattgaacaaccttaagttttctaattaccagtagaatcatctgggctaggatcaaaattcagccattccacactcagaggatatgcagacaagagtatatcatggtgtacataaaaagagtcttcttcttgattataaactgaaaagattgggaaaagagactttaatgtatcagaatgagtcatcaaaaatcacatcccgctcaaaaaacaaattctattaaatgtacgtgagccatgtgctttaaagtgagacatctgatattataaagagattccaggctgggcgcagtggctcgtgcctgtaatcccagtactttgggaggccaaggtgggcggatcacttg

SEQ ID NO: 7120 - DNA, 456 bp, Homo sapiens
aggctcccttctgatgaaaattgagctgtccatgcatccatggaacccgggttacagcagtgagggggccacggctcaagaaacttacacatgtccaaaaatgattgagatgcagcaggcggaggcccagcttgctgagggggagctgctagccaatatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaacattgacatggagat

SEQ ID NO: 7121 - DNA, 585 bp, Homo sapiens
ctacagagggggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcgaagacaagattatgctggcaaaggctggctccagcactgctgatgggaatgtgctctctgtcctg

SEQ ID NO: 7122 - DNA, 607 bp, Homo sapiens
gacagaggggagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctgtcaatgtcttaccaaagaaagggctcacagcaaagcaaactgaaagaatacagatgattaatggcagtgatcttcctaaagtatcaactcagccacgttctaaaaatgaaagcaaagaagataaaagagcaagaaagcaagctataaaagaagagcgcaaggaacgaagagtggagaagaaagctaacaaattagcatttaaactggagaaaagaaggcaagaaaaagagctgctgaacttgaagaagaatgttgagggtctaaagctatagacagtggagcatacagggcaaggcactttattaggggctcctcatctttggttattgactagaaacttcagaaagacaaaactgtttgccatttttactggcagataagaggaaaatacaatatttgtattatttttatactagtaagtgtcccctg

SEQ ID NO: 7123 - DNA, 129 bp, Homo sapiens; identical to SEQ ID NO: 2138

SEQ ID NO: 7124 - DNA, 235 bp, Homo sapiens
aggagaaggccatatccagaataatacaggttttgtgacttgagtagtgctcagttgagattgtgaagtgagcacagtccttttaatcttaacgcaaatcagcttcagggacttggaattaacagaagatgagtcttcccagtgaagtgagaaatactagaactgttctgactgagcatgaaggtggaacatggttgggcatggtggctcacgcctgtaatcccagcactttggg

SEQ ID NO: 7125 - DNA, 554 bp, Homo sapiens
gacagaagggtgttgaggaaccactgaagtattgatttttaagccaaaaatgacatgacagggttttctttatggaaagatcactccaaattgcatgtagataagcctatgaaaagcaaagagataattgtctaggcaggaagtagtgaggacttcttgctttcctcaagatacactgaaggcagttgaaaagctcatttttaaaagtctggtgaaaaccactttgttcacttttgttttgtgggagatgtgacacctagtaataaagagttaacaaaccctttccccttttatgaaaatttgacttttcgttaactccctagtttcccagaaaacaatgaaaaattgtgtttgttgcttatggtaaaaataacccaattggtaaattgcatctggagagggagaattgtaaatacttgaaaggaagccatagctttggacttccctgattgtagtgactcttataactgtcccttgtggaaattctagaagttctgcctatggagttactactagagatactggctcctgtggtacatggggccttctgccct

SEQ ID NO: 7126 - DNA, 537 bp, Homo sapiens
acagaagggaattctttttcctgagattccagcaaggttgtgacattgtcacttttttgttctagactcttttaaattttctgcatttgcctgaaaagcacccctgtaagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgttttattaaaccgacagtggtgtcccagagaggaaccataaataaaatggaaatctggtgctgtgataaagtaataactagcattaatgagacctggttttcctttc

SEQ ID NO: 7127 - DNA, 271 bp, Homo sapiens
gtggaatcaacatacaattttgggaaaatgtaatcatactctgcacttgaattattctctctacactctgccttagaatatttatatggatataatgaaaatcccatagaaagtgcagttttcatactcttacactctgaaagctgccacagtgttggtgaatatataccatattatatttttacatgcttgtgtgctaaataactatggcatgcatctttatttacatgaagtgaaaatacaaatatagaaagtgtatgggctgggtgtg

SEQ ID NO: 7128 - DNA, 537 bp, Homo sapiens
gattaatgtcctgttgctatgacaggaaccgcatgagacacacacgaaagacggccctgccttccagggctcgctagatccttggttcctgtcgtggaagagaggggcagagtcttgctctgtcacccaggatggagtgcagcggcgtgatctcagctcattgcaacctccacctcctgggtgcaagcgattctcctgcctcagcttcccaagtagctgggattacaggcgtgcaccactacatccagagactgggactacaggcatggattttcaggtttataacatggcagagtgaattctggcaacacactgagttatgcttgtcaatggccactatcaggaatttaaaacaagatttggaattatgacatctggacaaacacatatgcaaaacctaccttttggtccattctccagggcttcttctgcagcttctggttccagttctttctcggagctgtcagtgtgtgttttggcctgtccattaactgacatcatattacttggtacagttgcattcacttttgatgatgt

SEQ ID NO: 7129 - DNA, 302 bp, Homo sapiens
gtattttgagtagagatggcttttcaccatcttggccatggtggtcttgaactgctgaccttgtgatccacctgccttggcctccctaaggactaggattacaggtgtgaaccaccatgcctggcctttttttttttttttaaaaaaaattccattttttttttaagcttaaaggcttgggggaaatttttgtttaaaaaaaccctccttttaaaagggtaaagggatttttgggccctaaccccccaaaaaagtgggaataaagggccaaacccaccacccggggtaattttttttttttt

SEQ ID NO: 7130 - DNA, 519 bp, Homo sapiens
gaaaataagttcaggagggacctgaagaagctccaggtgaaatgttactgtggtcgtagagacggggaggggacctgagctgacgaagtggacgggtggtagacagaggagctggaggctcttcagttgtagggaggggcaaaaaacagatgcccagagaagccaacaggcccccagtggactctcatggtagaagaaagtggggaggatcaccaccattgaggcaggtccttagggctgtggctccaggaactccattttgtcagggtacccagagccaaacaaattctgcgggatggactatctgttgactgaagatctataagccaggtgcagtgtattcatttgcagaaaggactatgtccttcccacaactggaatgcttgtgtttgccttccagggctcccttgtttctttcctccgattatctcccaccctctccttaagggtcctgacctttcctgtggcttcaatggccacctgtatgcagactccacagtctttatttccagtccccac

SEQ ID NO: 7131 - DNA, 602 bp, Homo sapiens
ggggcctggcgcttgcggcaccggccgaggtgcgggtcgcctccagagatttctccgcagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcaggggtgtgtgttggatttgacatagatgaagacgcattggaaatatttaataggaatgcagaagagtttgagttaacaaatattgacatagttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaa

SEQ ID NO: 7132 - DNA, 490 bp, Homo sapiens
gtgtcattgcttgattggcgtttgacaaaggcttgtattgtttgcttgctgacagtccagggtactggccaggggtcacttttacttagggaatggaccttgctgctccctagccttattcaaaatggcacctaaaatatgtgtggtgtctccaattggctgtaggtgtgtgattcgttgaccatccctgtttattctgttacagttcctttattgaagattcagcatttacaaagcatgatacgaatcaagagtattgtttgatctcaaggtggattcttgatggtctagaatcttgaatcgaattcttaatgattgcccaacccctttctaaagccataacaacagtagaatggctcttgaaatattctaatacttaaacacaccagtagattcacacacataaaacaaaacccctctgtttcctcaaaatgccagcgctgaccagagtttcttttttaaaatttgagctttatcttaaatatttaat

SEQ ID NO: 7133 - DNA, 404 bp, Homo sapiens
  misc_feature 201: n = A,T,C or G
acagaaggggttaaagccgctttaccagtttcacgttttatggatcatgcttttgatgatgtgccaaaagcatgatccataaaatgtgaaactggtaaattggtacatgggtacaaggattttctcctatgttttctttctttctttctttctttttttttttaaagggagtctcgctttgtcgcccaggctgaagtgcangggtgtaatctaagttcgttgaaagctttgcctcccggtttaacccctttttcctgcctaagcctcccgagtagctggaactaggcacccgtcaccatgcccagctaattttttgttttttttaataaaaacgtggtttcacggggtttgccaaaagggtctcgatttcctgacctcgggatccacccacctaagcctcccaa

SEQ ID NO: 7134 - DNA, 542 bp, Homo sapiens
gacagaagggggaattggctagagcgccagagccgagtcagccattaaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccatcaacctcatacgtatctacctggtctctga

SEQ ID NO: 7135 - DNA, 516 bp, Homo sapiens
ggctgcagcagattctgtgcagcagagacgccaatacagacgacaaaaccagcagtcttcatctggtatggatggtgatgaaagttttttttctacctgtatttcctattaaaaaatacttggtacataaacatctgtgtgtgcagcatgagtacttacttgcctacatagaaatctgtctgaggaggcaggattgtttctttttttggttttaagtccttttgcaaaatttaattttctgttacattgttataaaagtaataggtccctaggatacaatagtgaaacagaaaacagaagtataaaattggaaacgtatcattctttttccaacctcctaaagcttttattcagaaattttctgtgcatatagaaaaaggaaaagaaaaaaccccacagaagctcaactgtagatatgttgcctcactttttaacttaacagtatatttagaacatctttccctattaaaaatctagactgggcgcagtggctcacacctgtagtcccagcacttt

SEQ ID NO: 7136 - DNA, 561 bp, Homo sapiens
ggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctggaccagttctttcttgagacagactatactgagacaacaagttgtcaccagcagaagatagataatatgacctttattaacttgatgaattaactta

SEQ ID NO: 7137 - DNA, 83 bp, Homo sapiens
caatgctgccaccctcttgtctttcaaagttgttagtttactccattctttgtgacacgagtcaagtggctcacaacctcctc

SEQ ID NO: 7138 - DNA, 548 bp, Homo sapiens
gtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggcgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtgggttgtttctctggtcttgagtgactgtgtccacagttcatttttttccggtaggaataactccttttctacatccacgctccatagagtctctccttt

SEQ ID NO: 7139 - DNA, 529 bp, Homo sapiens
gacagaaggggatgtttttttacttacactaggaagtacatggcttagtgatcactaaagactcattttgtgcttttgcagctgtgatgaaagcaataatatgcaaataattactcttatggcaacattaaatgtagatatatacaggtttttcagaaaagccattaattttaaccttattggacatcagagctaagtaaacttttaaaaagctgttctaagtaatgtgttcagaatctagttgcagtcttaatcttcacaaagtgtaaatccagttaagatacttaagtaagtacctccagttagttactcttagtgagtgttttcttgtattaccactacagagaaaaatatcacttaaactggttattttgctgggggcgggggttgtgccacgcatggtggctcatgcctgtaatctcagcactttgggaggccaaggcaggcagatgtagcgaagccctgcctctacaaaaattataaaaattagccgagcgtggtgacatgtgctaatagtcccagctactca

SEQ ID NO: 7140 - DNA, 432 bp, Homo sapiens
acagaagggattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatctt

SEQ ID NO: 7141 - DNA, 443 bp, Homo sapiens
ggtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacc

SEQ ID NO: 7142 - DNA, 515 bp, Homo sapiens
ggcacacagtgcttcctaagcaattgaaaagtgtgaacagtattaaaaggcaaacctttagtctgctaaaaccaatccttttcaaatattatgtctatgtagcatcagccatttaaataattgagactaataaacacttattagtcttttcaggtttgtagtggtctctcagagagttcttcacgataagagtgctattcatacatacttgagagtaattaaacgatccctctggctgggcacagtggctcacacctctaatcccagcactttgggaggctgaggcgggcggatcacctgaggtcaggagtttgagaccagcctggccaacatggtgaaaccctgtctctactaaaaatacaaaaatttgctggtcgtggtggcgggtgcctgtaatcccagctactcaggaggctgaggcaggagaattgtctgaacccggaaggcggaggttgcagtgagcccagatcgcaccactgcactccagcctggccaacagagcaagactctgtctc

SEQ ID NO: 7143 - DNA, 130 bp, Homo sapiens
aattctcagtataagccctttgtcgtttctatgcctatttaaagtctcctaaaggtgtaattgactaggaaggatgtagttctacactgccatttacctatttaaattcatccttgtgaatatctttgtt

SEQ ID NO: 7144 - DNA, 130 bp, Homo sapiens; identical to SEQ ID NO: 2155

SEQ ID NO: 7145 - DNA, 588 bp, Homo sapiens
cagaaggggatatttaaaggttggccttttgcttctcgtgagtacaagccagagagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagcgtttatgcacaggagcataaatatatgattttcatcttgccattgaaagtagactttccggccgggcgtggtggctcatgcctgtaatcctagcactttgggaggccaaggtgagcagataacttgaggtcaggagtttgagaccagcccggctaacatggtgaaaccccatctctactgaaaatcaaaaaagttagccgggtgtggtggtatgcacctgcaatcccagctactcagtaagctgaggc

SEQ ID NO: 7146 - DNA, 466 bp, Homo sapiens; identical to SEQ ID NO: 2157

SEQ ID NO: 7147 - DNA, 503 bp, Homo sapiens
ggccttcagtgtcttcagacgccctgggaacgcggctgcagggtccggtcttcggtttgcactctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcagga

SEQ ID NO: 7148 - DNA, 580 bp, Homo sapiens
acagaagggatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcgg

SEQ ID NO: 7149 - DNA, 533 bp, Homo sapiens
gcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacaactgcagatgcatgggattctggatttttttgttgctttttagtttaatgggactttaaaagtaattg

SEQ ID NO: 7150 - DNA, 540 bp, Homo sapiens
agaagggatattagaatcaaagcaccaagacttcaaaagtccagactactcttcccaaagagaaatgtgcaatcacaatagcatgacatgggtacaaatatggaagtatgttattaaagtattgagaattagctttcctaacctccccacctgcaatcttttactcctaatctccaaaaaatgaacaaatcattggctcaaaatggtcacaaattgtatgtggtgttaaaaatctattatttttattgtatataaaatgttgccaggtgtggtggctcatgcctgtaatcccagcactttgggaggccaaggcaggtggatcactaggtcaggagttcaagacctgcctggccaacatggtgaaaccccatctctactaaaaatacaaagattagctgggtgtggtggcgtgtgcctgtaatcccagcttctcgggaggctgaggcatgagaatcacttgaacctgggaggcagaggctacagcgagccaagatggtgccattgcactccagcctagatgacagagcaagactcagtctc

SEQ ID NO: 7151 - DNA, 543 bp, Homo sapiens
aacctactttcaacttactaagaaggggatcatggacattgaagcatatcttggaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacatt

SEQ ID NO: 7152 - DNA, 536 bp, Homo sapiens
gataccatatgcgtgtctccaaagtggatgtggttgcctcaaggcaggtggcaggcaggggtgacctgctggccctcagatcaatggtcgtggcaggtctgagagctgtcccactggccagacttctccccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctc

SEQ ID NO: 7153 - DNA, 324 bp, Homo sapiens
gaggccgagggaggagaatcgcttgaacctgggaggcagaggttgcagtgagctgagattgtgccactgcactccagtctgggcaacagagcgagactccgtctcccccaaccaaaaaaaataaaataaaataaaagtggtatgcatatatatgtatgcagaaaaaacaggaaagaggaacagtttttttttcttttttgcttatttgtcttctaaattttctatattctaagtgttctataatccttttataattaaagaaaaaaattttaagttttatttcaggacaccattggaattaatactgaataaattaactaaaat

SEQ ID NO: 7154 - DNA, 518 bp, Homo sapiens
agaagggactccagcttacacgctgacaaaatgacataccgatattttaagccgccaccttgttcctgggtgcttgagaaatttttccagttagtgtaataagagttctgaattatctacagtgtataattatatcactcatagttgctattaccagcttgatgatgaaacttaactttaaaaaatattgaagcttgggctggatgcggtagctcacgcctgtaatcccagcactttgggaggccaaggcgggtggatcacctgaggtcaggagtttgagaccagcctgaccaatatggtgaaaccctgtctgtactaaaaatacaaaaattagccaggtgtggtggtgtgtgcctgtagtcccagctactcaggaggctgagacaggggaattgtttgaacctgggaggcggaggttgcagtgaggctgagacaggggaattgtttgaacctgggaggcggaggttgcagtgagccgagatcaccccagtgcactccagcctgggcaacagcctgtc

SEQ ID NO: 7155 - DNA, 507 bp, Homo sapiens
agaagggatggacagcaaagcctcaggactgtaatagatacaatgcaacatgcagtctacgtctatgacatttgtcatgtgatcatcgacaacctgcagttcatgatgggtcacgagcagctgtccacagacaggatcgcagcccaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaagcggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggc

SEQ ID NO: 7156 - DNA, 544 bp, Homo sapiens
acagaagggcataactaagtttattgtaagccattatcaagatgcattctcatgttgtgtacctggctccaaggaccacagttgattattatcttgggggacgtttattattccctctctgtctttgtaaataaaaatgacaagtcaaagtttggtagtagttgagaaaattgttgacgtgtaattacaggaatttgcttctttggttcagtttgttactttgaatctttacactgtctgcgtagctattgtggatttattattttctgtagctgcacagaaaataatgttttaatggtttttcataataaataatattattttccattttatgtggcatgaaaactctttcacattcatcactttgatctccctgactccactaccccgtatgaggctggtagaatatggtgggacaagtgtcacaacccattgaactgatgatcaaagatgcaaagaggccacatgttttgcccaaagtcgtgcacttagcaagccagaattcaaaccctgacctgatatcaagagtttactgcctgtcaag

SEQ ID NO: 7157 - DNA, 326 bp, Homo sapiens
ggggaatggagatagaggtttgatcatctatttatctctatacatggcaactaaaactatggagtgattcatcaacactcaggaaaaatgtgatgagagctgggctaaaaagctggccaaggtagatcagctgtgatgtgcagaaaggaaggaaacatcagtcagaattaaaagaaaacaaggagtgcttggtgtcttaaaagccaagagaaagaggccaggtgtggtggctcacacctgtaatcccagcacttaaggaggctgagatgggtggatcacctgaggtcaggagttcgagatcagcctggccaacatggtgaaacccc

SEQ ID NO: 7158 - DNA, 559 bp, Homo sapiens
gacagaggggtggaaggaccaaattttctggaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggaca

SEQ ID NO: 7159 - DNA, 61 bp, Homo sapiens
gggaactgaactcctcacacccaattggaccaatctatcaccctatagaagaactaatgtc

SEQ ID NO: 7160 - DNA, 462 bp, Homo sapiens; identical to SEQ ID NO: 2160

SEQ ID NO: 7161 - DNA, 498 bp, Homo sapiens
  misc_feature 391: n = A,T,C or G
acagaagggattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacatangaagcttgcttcaggcaatggctttggattgagcttgagaaattcaaacatttctgcagaacagataccaaatcaatagctaggaatcatgttcaatattgaattct

SEQ ID NO: 7162 - DNA, 567 bp, Homo sapiens
acagaaggggatacagctctagaatttcgtgaagttgcatgcaaagttgcatgcagcccgtgggtatgactgtctcaggcccccagctcatttgccaagaggaaaccttaacccccctgagagggtctgcgtttcttctagagctcctacctcagtggtgtgcacagagttggagacacctgagggctggtccacgtctcacctttgccatacgggtcatttcttgatcaaatatatgactggggtcctggtttactccgcccaccgtttcttttaaagtattcttaacatgaaatccacaaaagcggaaacaatgaaccattcttgcactttacagaatcattgtccttagctttagaggttgttaatttcttgtttttaacatgaacagaatgtgtggttctgaaggtgtgtgggggtctcaagaaattgtcctttggggccgggcgcagtggctcacgcctgtactcccagcactctgggaggccaagggggacggatcacctgaggtcaagagtttgagaccaccctgaccaacatggtgaaaccccgtctctactaaaatac

SEQ ID NO: 7163 - DNA, 534 bp, Homo sapiens
gatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgacgacttcactgggagccttctggaatcctgcagagggtcaaggagcagggatgttggatgcccacctgtcaagagttcagatcaaagttgcgctg

SEQ ID NO: 7164 - DNA, 567 bp, Homo sapiens
ggtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcgtggagaaaaccaaacaaatgctttttggaaaggaacccatatttgagagaaaccctgggtaaagggtgtaggaaaggttttgtcatcacacaaccctgtcacacatgaatgtgtagtggagagaaccttggtaaatgtaaagagtgtgggagagcctttagtcattttagttccacttgaag

SEQ ID NO: 7165 - DNA, 365 bp, Homo sapiens
tgatactgacctgtaaatcatcctttaggtaagaagttttaaaaagccggtttgggtaaaatacttttactctgcctacagaacttcagaaagacttggttggtagggtgggagtggtttaggctatttgtaaatctgccacaaaaacaggtatatactttgaaaggagatgtcttggaacattggaatgtccagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctg

SEQ ID NO: 7166 - DNA, 487 bp, Homo sapiens
gagaaatcacactgacacaccaccacactatcacagggacacagacacacggagacgtcaccacatggacacactgtcacactaccacagggaggggagacatcacactgtcacatggacacaccatcacacacatgaacacactgacacactgccatatggacactgccacacacactgccacactgtcacatggacacacctccacaccatcacaccaccacacacactgccatgtggacacaaggacacacagacactgtcacacagatacacaaaacactgtcacacggagacatcaccatgcagatacaccaccacatggacatagcaccagacactctgccacacagatacaccaccacacagaaatgcggacacactgccacacagacaccaccacatcgttgccacactttcatgtgtcagctggcggtgtgggccccacgactctgggctctaatcgagaaattacttggacatatag

SEQ ID NO: 7167 - DNA, 527 bp, Homo sapiens
gagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtcttttacattggcttttgctttctaaatgttctccaag

SEQ ID NO: 7168 - DNA, 58 bp, Homo sapiens
cagatcatgtctctgctactcgaatcttgtgtggagcccttgtctttcctactattgc

SEQ ID NO: 7169 - DNA, 77 bp, Homo sapiens
tataagaaggagaacaaagaagttattcttaaacttctggtcatatttgagaacataaatgataatttcaaatggga

SEQ ID NO: 7170 - DNA, 457 bp, Homo sapiens
agtcgactgttgcgcgtgcgcgcgctgtgacgttccctacgcggtcgggcgttgggtttcgcggcgctcgccgcactggttgttcagcaccttcggtccggttgaggttgtcaagtcgggccaaacaggttgtttctctgcagtttccaacatggcagggaggtttaatagacatggataagaagtccactcacagaaatcctgaagatgccagggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatg

SEQ ID NO: 7171 - DNA, 114 bp, Homo sapiens
taaaaatgtaattaggctcagtactcatactgaataactgttaatgattccaaattaccctatttgctgagggtattctacttatgttctcccttgggctttataaaattaacc

SEQ ID NO: 7172 - DNA, 157 bp, Homo sapiens; identical to SEQ ID NO: 2166

SEQ ID NO: 7173 - DNA, 489 bp, Homo sapiens
tggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagt

SEQ ID NO: 7174 - DNA, 125 bp, Homo sapiens
agacgagacgagacgagactggaactgcaaagattgcagctgtgataaaggatctcaagacaaagtcatcccggatcatccagctgtgcatgatggctcacgcctgtaatcccagcactttggaa

SEQ ID NO: 7175 - DNA, 103 bp, Homo sapiens
gcaattattatgatcaagtgagattatttttgtgaagccatgtaaactataaagtgctttccaagcatgaggaattactgtggatgatcttgagtttcacatg

SEQ ID NO: 7176 - DNA, 64 bp, Homo sapiens
gagtaaataccttacacagctgtcctctgggtttggttttctattttcttctccaaaagttaag

SEQ ID NO: 7177 - DNA, 263 bp, Homo sapiens
catgttacatataattctgtgttatttaatataggaatatgccccgtgataactatggaattttttttttttttttaaaacaaagggttcccttttttccaaaggggaagggcatgggccaatttggggttaaaaaaacccaacccttctgggtttaaaaaatttttcttgcttaaccctccaaataagtgggaataaagggcccttgcccccaccccgggttaattttttttttttaaaaaaaaacgggtttcccctttgtg

SEQ ID NO: 7178 - DNA, 64 bp, Homo sapiens; identical to SEQ ID NO: 7176

SEQ ID NO: 7179 - DNA, 477 bp, Homo sapiens
aaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactgtatagtatcatgaagttatatctttaaactcttagtttgtactatgtggtgtcttatgaaaaccttgatttgtttatacttagtgaatgaaacacttgggtttaaagttctttaactgatgtcacttcttaggctagaaagctgttgaaagaacttagtgttccacccttagaccaaggttcatgtcaccatatttaacagcagctttgtattacggtcaagattgtttgaagaattcagcatacaaacttaatttacagatgcaagcctgcagatggacctcccca

SEQ ID NO: 7180 - DNA, 372 bp, Homo sapiens
agacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggaaacattttatttaaaaaaaaaaacgtcaattgggcgtggtggctcacgcctgtaatcct

SEQ ID NO: 7181 - DNA, 102 bp, Homo sapiens
gtttcattaagcattttcatttgttcgtttaaaacaaagaacaacaacaacaaaacaaaggccatgtttggtgactgacacctgtaaaactagcactttgag

SEQ ID NO: 7182 - DNA, 557 bp, Homo sapiens
aacaaatcaacaatcaactggaattacaaccaaatctatgtacttctgttgtgagatctttttacttgcaatcctttgcaaaacgtgctgtgcacaatgtagtaagtatgcttgtaataaacaattaaaggagcttttcacgtgtagaagtgcacgcttaatttttgttaaatcatctcaataaatacttataagtgaagccaacatgattttcttaagttttttgaaaatgtgtgtacctataactgctgtgctatttgcaagaggcagtatacacacaaatttgatgatttcattctttaccaaatactatatttagcacattaaatactaagaaatagcactaaaatgggccgggcctggtggctcatgcctgtaatcccagcactttgggaggccgtggcagacggatcacttgaggtccagagtttgagaccaacctggccaacatggtgaaaccccgtctctactaaaaatacaaaaattgctgggcctggtggtggatgcctgtaatcccagctactcgagaagcttgggcaggagaatcacttgaactc

SEQ ID NO: 7183 - DNA, 574 bp, Homo sapiens
acagaaggggcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaagcacctcg

SEQ ID NO: 7184 - DNA, 511 bp, Homo sapiens
ccactcaaaagcaacttcctaacttgaggaataactcctttgtagtttactttctggtactggttggtgccttgtattgggatacagctatattcttagctcaaatgtcctctttttgagagcaaagtagttatccaatggtgagacgagaccctgacgctcatagaggccattccttcctgggtgtcggaccagggctctgtgtcagggaaaaccttctgggtggactttgtaagaatccagtttccaaggttagattcacatccttaatcttgcagagactagaatttcacagctcgctttggaacatattccaattcaaccagttaaaatcagaggaccaagtcgtgggggaggggggcggtgttgaggagaggtatttttaaagatctggcaacttttcaggattatttgtggagaactctaaggttaagatcaggaaataaaagactgtgtgtgtgtgtgtgtgtgcgtgtgtgtgttcaagtgcctaaatcttgtttacctatca

SEQ ID NO: 7185 - DNA, 74 bp, Homo sapiens
gcattacttgaagctggtgccaaagtggttgcgctcgaaagtgacaaaacttttattccacatttggagtcctt

SEQ ID NO: 7186 - DNA, 530 bp, Homo sapiens
gggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttat

SEQ ID NO: 7187 - DNA, 523 bp, Homo sapiens
ggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagg

SEQ ID NO: 7188 - DNA, 596 bp, Homo sapiens
gataacaaaggaagcacagagagtggaatcaaatggctaataaattttctggaatttcttagaaattccatttaaccatatgatatgcttagcagaaattgaataaagattgttaccttcatgttatttttttttctggctcttaaaatgtgcttgggagacagaacaataacttaaaattacagcttagttgaacataaggaatttttagtttttgccttttaatttatggcaaaaatgatagacgcctaattcacactgttaaattttagatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttga

SEQ ID NO: 7189 - DNA, 565 bp, Homo sapiens
ataaaataagtattgagccgggcatggtggctcacccctgtaatctcagcactttgggaggctgaggcggggggatcacggggtcaggaaatcgagaccattgtggctaacacggtgaaaacccatctctgctaatttttgtgtatttagtagagctgggttttgccctgttggccaggctggtcttgaatacctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacaccaggtatttctctaatagagtatgtgccacactttctgctaactgcctgtttatcagtgtccccacatcccaatatctggttccttcaagggcagggagcacagggtatggcgtcagagtggtcctcagtgatgtttactggtgggta

SEQ ID NO: 7190 - DNA, 553 bp, Homo sapiens
acagaagggataaaataagtattgagccgggcatggtggctcacccctgtaatctcagcactttgggaggctgaggcggggggatcacggggtcaggaaatcgagaccattgtggctaacacggtgaaaacccatctctgctaatttttgtgtatttagtagagctgggttttgccctgttggccaggctggtcttgaatacctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcaccattatggaggacttcccttgggaggcttgttagctgtacttgcaatctgatttgggttcccaaatcagcatataacaccaggtatttctctaatagagtatgtgccacactttctgctaactgcctgtttatcagtgtccccacatcccaatatctggttccttcaagggcagggagcacagggtatggcgtcagagtggtactc

SEQ ID NO: 7191 - DNA, 216 bp, Homo sapiens
aatagccaagtttattttaactttagtcattactggatcccagagattttctttctcttttttggcatatagattatttatgtcacttcagtatgcccagtccacagatgagatcttctgagggactgcttctggagccggccctcttgtgtgattgaattagtcagtgatggttctcaggactagattagattgttactcttaaaataattactt

SEQ ID NO: 7192 - DNA, 588 bp, Homo sapiens
ccctttctctggcataactgagctgctggtagtgccctactcactcatccttctgttgtaggcaaatactttcattctttcaggcctcgctcccgctcttgctgctaccgggcatgctgtcaccctttcctgccctctaccccttttaatctggccagcctcaatatttaagtctctgcttgggcatgtgttctagaaaagccatccctgagatgctttattttcattctttttagaccctaatgcctagcatgtatgtagcaggactcaatacaaattttctgagtaaaacaaagactgtttttacaaagatgatgtgcaagactctcccctgcagttttggagcagaggggacagacatatggagaaataatgtacagcttagggggtaaagatgccgtagaaaaatcagtaaaatactaaggcagcctcaaggaaggagatacctgtttatttggggaaagacatgcagaatcaaggaagacttcacatagaattgtttcaaaagatgaaaataaggctgggtgtggtggctcatgcctgtaatcccagcactttggaggctgaggtgggcggataatgaggtca

SEQ ID NO: 7193 - DNA, 554 bp, Homo sapiens
gacagagggggagctccttcctgttcccctggcggcccctcgcttcttccttctggatgggggccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacaccacaaaagtctttgtcgccttccaagctttcctccggggtatggtcatgtacaccagcaaggaccgctatttctattttgggaagcttgatggccagatctcctctgcctaccccagccaagaggggcaggtgctggtgggca

SEQ ID NO: 7194 - DNA, 533 bp, Homo sapiens
gacagagggggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgttt

SEQ ID NO: 7195 - DNA, 366 bp, Homo sapiens
acagaagggaacaaagtggttttgggggcttacagcagagtaaacataactcctgcctgacttgtggcaaatgcgtcttttggagttatgagtgcaaggttacctttagtcttcaatcattgtgtattagcctagttttcacctgtagggagcattctcctcctcctctgtgcacggttgcggtggaactctgtgggcatccctctgagcctttgctggtgctctgcacacgctattaattacatgaaaaatattattacagcatttttaaaaacctatcaagcagctaatattttccgcccacccacatttaccacaagcaattttgcttccacttacctgcctgccactcatttcattagttta

SEQ ID NO: 7196 - DNA, 581 bp, Homo sapiens
acagaagggcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagaca

SEQ ID NO: 7197 - DNA, 336 bp, Homo sapiens
agcaggacagtgttgggatgggctgattgtgagtatggagttctttctggaggagctccagcaggagctgggcaaatactgggagctttgactaaggggcatgcattgcagatgaggtttgaccagaggttttccaggatccctgaagaactctgcacttctaagcctgtaaggccacaacaggtgagatgaagggggagttgaacttccagctccttgtgtgtccccttaggttccccttttgggtccacacaaaggctcttgagcccaatctgaaggtctaaggctatggatatctcctccatttctaagttgggacaaggttgtccagcaaaa

SEQ ID NO: 7198 - DNA, 575 bp, Homo sapiens
acagaaggggaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggac

SEQ ID NO: 7199 - DNA, 489 bp, Homo sapiens
gtgcatgagattttcagcactgtagaatttcacacaggcacaagcataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagccaactgttagctcatctgactatctgtctagaccaagggtcggcaaagttttcagtaaagacccacagagtacatattttggagtttgtgttgtctgtaccaacagacagacatggtgtctgtcccaactacccaactctgccattgtagcactaaagca

SEQ ID NO: 7200 - DNA, 77 bp, Homo sapiens
aagcttgcggccgcggtttttttttttttttttttttcccgggcccccaaaatttttatttttttaaaaaaaaaaaa

SEQ ID NO: 7201 - DNA, 61 bp, Homo sapiens
agcttgcggccgcggttttttttttttttttttttaacccccccccttggggggggggggg

SEQ ID NO: 7202 - DNA, 442 bp, Homo sapiens
cctcagttcaccttctcacaatgaggctccctgctcagctcctggggctgctaatgctctgggtctctggatccagtggggatattgtgatgactcagtctccactctccctgcccgtcatccctggagagccggcctccatctcctgcaagtctagtcagagcctcctgcttagtaatggatataattatttggattggtatctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttatcactgcatgcaggctctacaatctcctcacacttttggccaggggaccaagctggagatcaaacgaactgtggctgcaccatctgtctt

SEQ ID NO: 7203 - DNA, 602 bp, Homo sapiens
attcggcacgaggcaagaatgtcatattctcaaggaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactactt

SEQ ID NO: 7204 - DNA, 483 bp, Homo sapiens
  misc_feature 377: n = A,T,C or G
cgtcttcactgctctgtgtcctctgctcctagaggcccagcctctggtcctgtgacctgcaggtattgggaatccacagctaagacgccgggacaccctggaagcctagaaatggacaacctgaggtatggagtgtatcctgtcaagggggcaagtggataccctggggctgagaggaatcttctggagtactcttattttgaaaagacggagtttcgctcttgttgcccaggctggagtgcaatggcgcgatctcagctcacctcaacctccgcctcccgggttcaagcgattctcctgcctcagcctcccgagtagctgggattacaggcatgcaccaccaccctggctaattttgtatttttagtagagacggngtttctccatgttggtcaggctggtcttgaactcccgacctcaggtgacctacctacctcgacctcccaaaatgctgggattacaggcatgagccaccgtgccagg

SEQ ID NO: 7205 - DNA, 598 bp, Homo sapiens
  misc_feature 592: n = A,T,C or G
cgtatttatttattttattatttttttgaaacatttttacatgtttatttatcaaaagtgaaaaagcatacaattcaacacaatttcaatagcatttgacaccacccctgtggatcctgtacatggctgacgtcaccgtccagtgcaaaatcaaaaaagaaagaaagaaaaaccccaaagaaagaggatttttcagtggagaacatggtgggctgattaggcttctattagattacattcatttcacatctgtgtgcaattctcccataaattggtctttaaaatatatatatatatttaaagatattagaaatatatatttaagtatatttaaaatatatatatttttaaagagacgggggtctggtatgttgcccaggctggtcttgaactcctgggctcaagcaatcctcccgccttggcctcccaaagtgcttacatcctcttgtgccctaccctctggctggtaggtttcagaaatattatctaaggtagttgaatccgagctgccgtctctctcaccaccccccctcacgtgtccactgctcacacacagcagccggaattgacacttgagtgagtaccatgcggngtgagt

SEQ ID NO: 7206 - DNA, 483 bp, Homo sapiens
aagcttgcggccgcggttttttttttttttttttaaaggactccctactatgtttttttttttaaaaaaagcagattttaaaaatttgtttactggggaaaatttaggggatccaaaaaaaaaaaaaaggttagtataatcttaacggcctaaaaaaccctttataaacatagggggggtttcttttaaaaaaatttagtaacccaatttggggtctaagggtattttatccttaaaaccaaatttttaaaaaggctgcaacattgggaaaattttttttgtcatttttgaaggacaaaaaccccaaaaccatttttgataaaaccaaaattggccaaagggtttttaattccccttaaaaccttttgcccggcaaaaaaaaaaccaaaaaaaaacttgccaccaaataaaccaaaccccccccaaaggggaaaaaatttttgcaaacttcccctttgaaaaagggcttatttcccccctttt

SEQ ID NO: 7207 - DNA, 405 bp, Homo sapiens
cactgtgagcacaggttcttctaccttggggccacacccagttacctgtatctcactgcacagcagtggctgttggggaccaggcccacccctccatgtcccacctcctgcaactgcagcctgagccttcccatcagcctggggtggtgcagacccatgtgccattgtggatccttcaagttacctgtgtggcagaaaggacgtgtgagtgccgtccaaacccaaacactgagagggtccttcccattgcccccacggaagtaaggtgccccagtgctaattccacttatacttgctggtggcaaggacacttctcctccttattaaagtgggggattggctgggtgaggtggctcacgcctgttatcccagcactttaagaagccaaggcaggtggaccacctg

SEQ ID NO: 7208 - DNA, 267 bp, Homo sapiens
gcagtaatgcttgcttgtccactgttcatctcctcccgtacagctaagttcctaacaggtaccagtgtctgaagcctggggactggcggctgctggtcaaggccacattagtttattgttaagtgcaaggtttctggtaacagaaataaagaattcaattgattcatcatcaagaccaaatatatttactaaagatctaccttaaattcattttttagcaggtagtatggcattgtggttaagaatttacatttgtgaacatttacc

SEQ ID NO: 7209 - DNA, 381 bp, Homo sapiens
gacttttgtttttctcttcataatagtttgtttcctcaactaaaacgctatctcactgtaagttatcattagttttgtcttccctatttgattaaaagtctcttgtgccatctgtctcagactgctttgcacacagcaggtactgaatagagttgttggttaatcactcaatgtagtcacacaatagtgaatcattatacaaattcctgaaagacttcaactcctccccttgctaatggtttttatggaggttaactttttaatatcaccaaaccaatcgtggggaaaatttacagagttctttcttttttgctttattaaagaatagtgttagccaggcgtgttagtgcacacctggagtcccagctacttgggaggctg

SEQ ID NO: 7210 - DNA, 572 bp, Homo sapiens
caagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccaaagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctgg

SEQ ID NO: 7211 - DNA, 342 bp, Homo sapiens
tggccaaggactgtgcaaagaagattgtagcaagttcagcaatgggattggttaataaggacattggaaagaaactaatgagttgtcctttggcaggtctgatcagtaaagatgccataaaccttaaagccgaagcactactccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatg

SEQ ID NO: 7212 - DNA, 76 bp, Homo sapiens
ggtaccccaatctgaagtcagtaaatgaactaatctacaagcgtggttatggcaaaatcaataagaagcgaattgc

SEQ ID NO: 7213 - DNA, 232 bp, Homo sapiens
gaagacgacagaagggtacggctgcgagaagacgacggaagggtacggctgcgagaagacgacggaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggg

SEQ ID NO: 7214 - DNA, 272 bp, Homo sapiens
ggttatgcatgggaattagtttctcaagtcagtaagataaaaattctgtagaatcagaataccatcaggctgggcacactggctcacgcctataatcccagcactttgggaggccaaggtgggtggatcatgaagtcaggagtttgagaccagccttgccaacattgtgaaaacctgttctctactgaaaatacaaaaattagctgagtgtggtggctcacgcctgtaatcccagcactttgggaggccgaagtgggaggatcacaaggtca

SEQ ID NO: 7215 - DNA, 589 bp, Homo sapiens
atatttgttgaataagaagaaaaatgaacaagtgcatgaatgcgtgaatgatgtagaagacaatccagtaataccaaagaatctattggaatcaaaattattaaaaagaaaatgcagatgaatggagaatttatgttaaaagccaaaagaggggggagctttgacttttaggcatcatcaaatttaataaagagatatcagtaacatactaaagcaaaagccagatggttttgaacttaagaataaatatgatgtaaggaaatgaacacagcccataaagccaacctttcaaaaagagtaacaataaagggagaatggtagtgctagagaggaatgatgggatgaaggagtctgagatttgtttgtctctttttaactttgtggcagagagaattggacatgctcaccaatttttctactactttgtcctgctttcctgatataccacagggaaagttctataaacatttcctactacaaagtgaaaagaaacctattttaaaagactggtttatgggattttatgtaatatttttcaatttttgagtaaggaaaactttctaagttttcagtctacctgaaaataagc

SEQ ID NO: 7216 - DNA, 495 bp, Homo sapiens
acgagtcctccgtattctgcaccagtattgtggctcaagactccagaggccacatttaccatggtcggaatttggattatccttttgggaatatcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctaaatcctttgaatggagcgtggttccgagttg

SEQ ID NO: 7217 - DNA, 496 bp, Homo sapiens
ggaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtcactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttga

SEQ ID NO: 7218 - DNA, 487 bp, Homo sapiens
atggctaaaaaagaaaaaacaggtatgctagcagtttaagaaacaggggtctacaacttcgattaaattttccaaaacgaggtggctgacacacgcaatcccagctctttttgaaagaaaatggtttgagcccacgagttcaagatcagcctgagcaaatatggcgagactcagtcttttgagatagtgcgatcctggcttactcactgcatctttggactcctgggttcgaacatccacatcagcctctcagcagacacgtgccataacaacgggctagtgtgtatttttttgttttcatatgtatatatggtttttgtttttgtttggtagagaggggtgtttcccccgcgttacccagactagtctcaaactcctgggatttgggctttgggatcaagcgatcctcacccccaaccccaaagtgctgggattacaggtatgagccactgcacctggcactctaccaaaaaaaaaaatgttttta

SEQ ID NO: 7219 - DNA, 452 bp, Homo sapiens
atctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccct

SEQ ID NO: 7220 - DNA, 495 bp, Homo sapiens
acccaacacacatgcatttcctccttgccttctcagtattgccatcgtgaaccagaattgtcacctccaatttaaacagtgaaggcctttgttaggaagaggggcagggtgcagagggggatggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctaaactcaagtctgtgcttttgctgggataaagtttgtgttgagtacatct

SEQ ID NO: 7221 - DNA, 518 bp, Homo sapiens
atttataatgaggttatagccaagttataggaacaaatgagcaaacagttttaaacaaggcagtctactgttaaataatatgcttaccttatttttataggcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacac

SEQ ID NO: 7222 - DNA, 514 bp, Homo sapiens
aactgttgcacctgctacctgaaggatgaccaaaccaaagcttctctgtgtacagactgctgactttaagagtttattctctaaagtgatctacagtttcctgtcatttgactctgttccctgtatttattgctttcttccttttctctgaaatgctattcctttaccttctcttacctttttaaaccctaaaagcaacaaataactttacttataggaagaaagagctagaggaacgaagtgatgtttggagggtaaataaatggaattttgggcagctttaacgttccaggctttgagctatgcattgagcgttaactcttacaataacctggggagaatagacagtcatttctttttgtagataagaacagagaatcagaggacagtgtcattatttcgtacaaaacaaaaagtgcattaagactagtaatgttttaaaaaatcattcgctgtcttttaaactcacagcatataacggcacttcccaaactccaatgtgcatgggaattgc

SEQ ID NO: 7223 - DNA, 425 bp, Homo sapiens
gagacagttttgaagttttcaaagactggctctgctgttaagaagttgtacttaaagcggaggagctaagccacctgccaaaatgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagc

SEQ ID NO: 7224 - DNA, 232 bp, Homo sapiens
ctctgaagtgttttatttgtggtataggctcttgagatctcatggaaataaaccaagaactatttgaagttatttggaagttattttacctttatttagaatatcgtcctttaagttgggaatgttcagttctcccctgggagcacttgtaagcacatatttgttaagcatgtagtgtgtttcagccactgcttgtgttattggagaaacacaggtgatatacaccgctgct

SEQ ID NO: 7225 - DNA, 351 bp, Homo sapiens
atcattcaagtgaaacagaagggctttcctggccagacacagtggccactcctgcaatcccaacactttggttggctaaggtgggaggatttcttgcggccaggggttcaaggctgcagtgagctgtgatccaccactgcattccaggctgggcatcagagtgaggcctctctctaaaaaaaaaaccactccccaaaaaaagggatttgcaaataccagcctttcagcatgaggatcacatggaggaacattaagatacagttgctgggacccagccctattgattgtaattcaaaaactgaggtggggcctgatttagctccatcattggaatccattccaatttgaaac

SEQ ID NO: 7226 - DNA, 411 bp, Homo sapiens
aaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactc

SEQ ID NO: 7227 - DNA, 124 bp, Homo sapiens
tggcttttaaggataccggaaaaacacccgtggagccgggtggcaattcaccgaattcgaatcaccctaacaagccgcaacgtaaaatccttggaaaaggtgtgtgctgacttgataagaggcg

SEQ ID NO: 7228 - DNA, 403 bp, Homo sapiens
acagaaggggatgggacctgcatatgtatattgctaacatgctcccaggtaatgctgatgcttcaagtcttggaaccacacttcgagaatcactgttataatgtacagcacaactgcatgatcaggtaagtgtgctgagctgttgatcctcctcattcctgagctgagtgtgcacagacaagagcaggagactaggggctgatgatcttttagtcacatccatttaccccagagtgctctatacaaatagcatttttatgtattccccggcatgaaaaagctggaaagcaccaagagaaggttggcgttaaacaacatgaagttttggaatctcaaaaagtctgaatgactgaatttttttgagctttagcatacttatcattttataatgaggataattcct

SEQ ID NO: 7229 - DNA, 485 bp, Homo sapiens
ggtctgctcataggggagcttctagaaaggaaggacttattgtcttagttacttgatccacttccttacctcctgttcatgcaactttgcttgttttgcttctactaaaatggttctaggtgctgtgtggacaggtgatacaaaagcctcactcacacggttgacattcattcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagggtctcactctgtcacccacgctggagtgcagtggcgcagtcatggctccctgtaacctcaacctctcagactccagcaatcctcctgcgacagagacagagtctcactttgttgctcaggctggagtgcattggcacaatcttggctccctgc

SEQ ID NO: 7230 - DNA, 552 bp, Homo sapiens
gacttccggtcgcgccagccgcccgttgccagttctgcgcgtattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaagtatggatgacccttactttttatatgtaacttaagccttactctaccctacccatgcgatacataatttaagaatagaatacatctgaagcaaaacagaaaaggcatgactttaaaagaacaacttttttttttaagtgctgactggtcacttgaagctttactctacaaatgggatatgaa

SEQ ID NO: 7231 - DNA, 604 bp, Homo sapiens
gggtgggtgttggtgctagcgcggcttcccggcgctcgtggaatcttctggagcccttttctccactcagcgagcctgagagtgcggaagtctccggctggtggggcatggcccaggagcactagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctg

SEQ ID NO: 7232 - DNA, 513 bp, Homo sapiens
ataatctttaaagccaaaggtttttttagacttgaaagaaagagccacttaaattcttgtttaaaaataccaatttgcctcctccttcctcacttcgttaggttatggtagtgctcagacatctgcagtgttgagaaggccagtcactgttggaagtcatccaagaagcccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtatataatacggtattatacctgcatgtgctctagcaaggataccaaggcaagcatacatgtagctggcttgagtttgtaccaaaacagtccttcaactttgcactgtgccttaagtaattact

SEQ ID NO: 7233 - DNA, 343 bp, Homo sapiens
ccttgtaaaaaactatttccatctatgtccctgaatttccaagccactgaagaaaaacaatacagaggttgaaaaaacctaattgttgcctacttacttggaaatgattgttgctggaaaaaaaaaaaacgttggccgtaaggttagtaatagttggggtggttgaattataaattctcatttctcatcacatttagtcttttttctccccagccattcttgttattattataaaattcaaattttgtcctcctttttaaaagattagttgctatttttaaaaaaagcatcctatttttgttattatataattcctgacaattacaaagggcctactttgatt

SEQ ID NO: 7234 - DNA, 399 bp, Homo sapiens
gacagaagggcttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttacttttttttttttttctgacagggtctcactttgtcccccaggcaggagtgcaggggctaaatcttgggctcactgcagcctaaacctcccaggttaaagcaattctcctgcctcaccccctcaagtagctgggactacaagcccacaccaccacccctgactaattttttgtattttttggaaaaggcggggtttcaccatgttgcccaaa

SEQ ID NO: 7235 - DNA, 480 bp, Homo sapiens
gacagaaggggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatgg

SEQ ID NO: 7236 - DNA, 470 bp, Homo sapiens
gggtccatgaatttcaggatgtccttgacatccaccagaagcctacaaaaattttgtgtactcatgcatttccttgaaaggctatgctttcatttagttctcctaggtagaaagactatggtttcatcagattctcaaagtggttaacaggtgagacagagaccacagtatctacccattcagaaaatgtaggatggacctggattctaatgccagctactctgctttcagctcaccttggacaccttgtaaaatgaggggtggtaaaataatagctatgtcacagggtatagagagaattacataattagatgtatatgaaagcatcattaaaaaaaaatcaggcacaggcattgttagcgccctctgcttgtctgcttgtcatctacaaataactgaatttaacagggaaggctcctctttgcagtttttgcagggagaatgtttcaaggtcattagccctcaatgac

SEQ ID NO: 7237 - DNA, 521 bp, Homo sapiens
aggtcaaggctgcagtgagccgagattgtgccactgcactgcagctggggtgacagtgcaagaccctgtctcaaaccaaaccaaaccacacacacacaaacacacatacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttgtaaacctgtctgcagtaggacactgaaaacagcaagaacttcggggtgaacacccgctgatcctttaacaaggatttctggcaggaaactcacaaaaaggagaactgaaaatttagacatacagt

SEQ ID NO: 7238 - DNA, 62 bp, Homo sapiens
gctgtgttcacactgaatttggggtcaatctatttcccccaccctctctcctccccaaccct

SEQ ID NO: 7239 - DNA, 546 bp, Homo sapiens
gtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccattagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaagggatttcccaggtccaccacctgctccatttgcaatgagaaatgtctatccaccgagggggttttcctccttaccttcccccaagacctggatttttccccccacccccacattctg

SEQ ID NO: 7240 - DNA, 597 bp, Homo sapiens
gacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaatggtgagacgggtactttggtggacatgaaggaactgggcatatgggagccattggctgtgaagctgcagacttataagacagcagtggagacggcagttctgctactgc

SEQ ID NO: 7241 - DNA, 82 bp, Homo sapiens
tatagtttagggcagtggaaggaaggctggcatcaaaatattttgatcaaaaaagatgacaatgtaaaggctcagttgtggc

SEQ ID NO: 7242 - DNA, 456 bp, Homo sapiens
cagaatttgtgtcctgccctatccatgtcttaaagatgagaagttggatccactgagttagtttcattggggcgggggaaagaactgtaattaaacttgtttaatccttattttgtattgtagctattttttgtaaaagcaacttaaaatcttttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaaccctcataaaccatgaaaatgtagctggccttcgggcc

SEQ ID NO: 7243 - DNA, 326 bp, Homo sapiens
agcactggcctggccttgaaagtacggaagtctttcccattcacttctctacaatgctgccaagacagaggcagaaagaaatggatgataattctgtcaagcacacgtctattctttattaagaaaaacaattatgtttggaattcatacatctttggttggaacgcattggcttttttttcttgttgtgatagaaatggaattaagtaaaattatagttcgccttttctgttgtcttcaaattttataatgtcttttattcttaatttaatcccattcaattatttaattgctatacattgacattaagtgctgtattttatgac

SEQ ID NO: 7244 - DNA, 474 bp, Homo sapiens; identical to SEQ ID NO: 2194

SEQ ID NO: 7245 - DNA, 540 bp, Homo sapiens
actgggagaacagaagacctcacaatttaatgcctcagtttttaaaaaaggatccttacacttcatgtctcctagccatcagaagaggaatgagacagcaaaagttcaaatggcctgtttcaagtttctgatataaaacgatgacattttcaggaaaatcctgcatttccagagagagactggctggttaaatttctgaaagaggacaccagctaaaagaaggtattgcatctcacccgagcagactgtgtctgtggaaagtgtaagccccttgccagaagagcagcttcccagcaaaggcagagggtgaaaacagcaaaggtcttaagacactggggacctagagtcaaaagggacctcctccagggaaaacgctgtgtgagaaatggcctcattcggtgactgtgagtgacacagcagaaagttgggtcattccggctgcttttttgagaagtccctgaagagatcaataacagcaagagggaacctggcaaggaagctattcctataatccaggaaagagatgaggaaggcttggac

SEQ ID NO: 7246 - DNA, 466 bp, Homo sapiens
ggcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaactt

SEQ ID NO: 7247 - DNA, 477 bp, Homo sapiens
ggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgc

SEQ ID NO: 7248 - DNA, 437 bp, Homo sapiens
ggctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaac

SEQ ID NO: 7249 - DNA, 586 bp, Homo sapiens
ggattctatgtgtgcctgatgcagtctgagttaatcttttatcgtcatacctattctttttagctttagtacttctgatgttttcttacctgcaaatttttatttcaagccactgttgaaacctcagtgtggcatcccatgagagccttttctcacagatggacacttcacagttaagtgtcattagtatgttaaagctaggaacctacccaaaagtacaaactcagtttactacatgattcccaaggatttttaataaattgtgttaaattccttgctgaatttaaggtataatgtatatctatctattcacccatccaaccaaaccaaccacagattcttcactcaagaaaatcaggtaagcttggcatgatttgccgttttgcctttatgtttcttgctagtgcttttttataatatttattattttgttttagactgaggttttatgtcaaatctgtagttatcagcatatgacctttaccttttagacaacttgagaaatcttcacccccatcccccacatttttatttcccagctttccattttcattgtttcacaaagattattaagaatacctgaatg

SEQ ID NO: 7250 - DNA, 313 bp, Homo sapiens
ataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagtcaactgttagctcatctgactatctgtct

SEQ ID NO: 7251 - DNA, 622 bp, Homo sapiens
gtatctgtctttctggcttgttagatcttctcatttggcgtcctttctccgaagagttaaccaagacgtttggcatggtttccttgctttcctcctatcttttgctgctagagctgctttcgaaaagaagtcttttcttgcagtggtatcttttctttgggttacagtgttgttcatcctttctttgccgaaagaatgaatcccagtgcttcacaaggttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggt

SEQ ID NO: 7252 - DNA, 118 bp, Homo sapiens
gacatcgagtccctcctcctcttctcccatgccttcttccctgccatggcaaatctgagtggcttctctaagcatctgctggtacaagtcaatgtggcaccatgagcttcatggtggc

SEQ ID NO: 7253 - DNA, 566 bp, Homo sapiens
acagaagggattctattgggtcttttgctgaacaaaactactacagtgaaagcccttttcagtgaaagatgtcagaaacctcaaaacctttggcctgactcagaactaccatgtgaaaatcagtactctcttaatgtttgaaataaaaactgaaaaaaaaaacaaaaaaacaaaaaaccttttttgaagcaccttaacgtggccatccatttgagaagtgggtgccactttttttctttgagcaccttattgatgtgtttgctatctgctgtctttctgttacctgttggctgaatggctagctgttaacatatacatgtgcacagaagagatatctgggcatgtatgttctcaatgaagtttactgtggtgactgctgaaaggtgaacccatttcctgatttttcccgccgcagtgttgtgataagattcgaagaaacctttttccctgcacagaaatgtttcttatcacattgtatcttagtatggaaaggaatatggtcccttttttgcaattgctactgtgtacacacacacacacacacacacacacacacacactctgtg

SEQ ID NO: 7254 - DNA, 548 bp, Homo sapiens
gaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctgaggccaataaggataacattatctacccagagagtttagaagaaaagtaggagtccgaaggaagagtaaacaagaatggagctgtgttcacactgaa

SEQ ID NO: 7255 - DNA, 86 bp, Homo sapiens
atactcaattgatccaataacttgaccaacggaacaagttaccctagggataacagcgcaatcctattctagagtccatatcaaca

SEQ ID NO: 7256 - DNA, 399 bp, Homo sapiens
tgtaacctcttcatggaaaattgggctttcttttttgatattttgtaacttgctttctataggagatggaggagatcctgggttccccgataacactcctctcaggttggggcaggcaaagaaagctcgtctatgtactgcaacaaggcacagttgttacttggctgggtataggccatgaggtctggggccaatgtttctctaaagattgtgggagagaacggggcatggtggtttgcgcctctcatcccaacactttgggcggccacatggctggatcatgaggtcaggagtccaagaccagactggccaagatggtgaaaccctgtctttaccaaaaatacaaaaattaggcagccatggtggcaggcgcctgtaatccagctacccaggaggcaa

SEQ ID NO: 7257 - DNA, 123 bp, Homo sapiens
ggtacggctgcgagcagacgacagaatgggggaggctgatgtgggtggatcaccctgagtcaggagttccacaccagcttggccaacatggcgaaaccccatctctactaaaaatagaatata

SEQ ID NO: 7258 - DNA, 531 bp, Homo sapiens
gaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattat

SEQ ID NO: 7259 - DNA, 487 bp, Homo sapiens; identical to SEQ ID NO: 2199

SEQ ID NO: 7260 - DNA, 440 bp, Homo sapiens
gagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcagg

SEQ ID NO: 7261 - DNA, 452 bp, Homo sapiens
attttaggtgctttgtggtaagtcttttttcttagattgcgctaaaatttcttagattttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactga

SEQ ID NO: 7262 - DNA, 405 bp, Homo sapiens
acagaaggggtaatataaatacaaaaagttcgatgactgataaggaatgtttagacagtggtaagcctttgaaggtcaattggtattttctagtaataagttcatattcctaaaaaaattttgacttgaaaatacgaaaaaatgaaattagttactgcaaaattgaaaactacttgaggaattctagcttggatcttggttctcagtaataggctgtcactactgtatcagtagctctaaacatgagcataatctttgacccaggatttctactcaggaatttatcctaaggaatatgtggggtttttttgtttgtttgtttgttttttttgcttgcttgctcgctcgctctctctctgtgtgtgtgtgtgtgtgtgtgtgtatgtgtgtgtgtgtgtgtgtgtg

SEQ ID NO: 7263 - DNA, 567 bp, Homo sapiens
ggccctgcttcggctcgcgcacggtgcgcgcacccactggcctgcgcccactgtctggcactccctagtgagatgaacccggtacctcagatggaaatgcagaaatcacccctcttctgcgtcgctcacgctgggagctgtagaccagagctgttcctattcggccatcttggctcctccagaataaacctattttttgaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcccgacagaagacacccactctaccaaaaacatcaacaggcattggaagtagtaaaataatgaggaaaaagccaaaataatgttggacaacatg

SEQ ID NO: 7264 - DNA, 558 bp, Homo sapiens
acagaaggggacctgtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataagtaagccattagtcgtaccatccctgattttttatgacatagtataacacagttttgaaacagtcttcctattgtgtagcagattcctgagtcttttaagtaacaatatctctatactcagggatcctgatcatagcagtaaaagtgatattaact

SEQ ID NO: 7265 - DNA, 495 bp, Homo sapiens
gctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgggtctattttttatatatgttggtattttttgaaaattccaaatactcatgtctcaagtaagctt

SEQ ID NO: 7266 - DNA, 263 bp, Homo sapiens
aggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcag

SEQ ID NO: 7267 - DNA, 527 bp, Homo sapiens
aaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcatta

SEQ ID NO: 7268 - DNA, 346 bp, Homo sapiens
tacggctgcgagaagacgacagaagggtacggctgcgagaagacgacagaagggcatctgaaaaaaaaaaaaaaaggaaggaaaaaaaattttggggatccgggggccctgttcctgggtctaaggggggggccagggcaaaggctcaaggaaacatgtccgggttccacacttttttccggggccagaccttttaacttccctgggggccttactgccccaaataaaaaggggctttttttcgggcccttaaatccttttaaaagccataaaccctttgttttatggatagtctttgaacctttgtttaccctttaaaacatttaaatttttttttttttttttt

SEQ ID NO: 7269 - DNA, 260 bp, Homo sapiens
tgttggttgggggccgtcccgctcctaaggcaggaagatggtggccgcaaagaatacgataaagtcgctggagtcgatcaactctaggctccaactcgttatgaaaagtgggaagtacgtcctgaggtacaagcagactctgaagatgatcagacaaggcaaagcgaaattggtcattctcgctaacaactgcccagctgtgaggaaatctgaaatagagtactatgctatgttggctaaaactggtgtccatcactaca

SEQ ID NO: 7270 - DNA, 516 bp, Homo sapiens
tcccagtactttgggagaccaagagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagttt

SEQ ID NO: 7271 - DNA, 519 bp, Homo sapiens
gacagagggggccctcttgggtgggttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatctgggtgatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggg

SEQ ID NO: 7272 - DNA, 568 bp, Homo sapiens
acagaagggacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatg

SEQ ID NO: 7273 - DNA, 86 bp, Homo sapiens
ctttcgctcatgcccgtggcgccgacaggatgggcaagtgtcgtggacttcgtactgctacgaagctccgtagtcaccgacgagac

SEQ ID NO: 7274 - DNA, 561 bp, Homo sapiens; identical to SEQ ID NO: 2203

SEQ ID NO: 7275 - DNA, 421 bp, Homo sapiens
atttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgcta

SEQ ID NO: 7276 - DNA, 548 bp, Homo sapiens
acaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttttctgaaccctcaacgtaggaagttaaactaaaacatggggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtg

SEQ ID NO: 7277 - DNA, 355 bp, Homo sapiens
acagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacag

SEQ ID NO: 7278 - DNA, 475 bp, Homo sapiens
gctcccctcccgcgccgccgctgtgcccatcacttccggtcgcgccagccgcccgttgccagttctgcgcgtattggagctggagtgagccttccaggaattttggctgccaaatgtggtgcagaagtaatactgtcatacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcag

SEQ ID NO: 7279 - DNA, 507 bp, Homo sapiens
gacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttata

SEQ ID NO: 7280 - DNA, 551 bp, Homo sapiens
gctgcatgctatttattgaaaaatataggtaacacatgtacataacaacatggatgagaaaaaatacacattcatgactttgggagaaaagggaataaaattggagacagacctaaaagggagctcagtttcatcatctatttttttcatttaaaggattcagaagcaagtatggaaaacattagtgtttgttcatgctggtggtggatattgagcgactgttatacagcaaatggactccctgccccacacacatagaaactaatactatggcaccagcttttgagaaaagaaaggctttgttacaaggctggccagcgaggagacaggagaaggactcaaatcagtctccctcacttggggcctggggcaagtattaaggggttggatgacaagagaaaggattcacaaatgttggcttggcaaggtccagttggaggtcttcaaatttgaccatttacagtaaggcatgttgacgcagattttagtcccagatcttcctggccaacagaccccttgctttgaaagagtgccggcggtcatattgcagc

SEQ ID NO: 7281 - DNA, 475 bp, Homo sapiens
ttcggcacgaggcgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttat

SEQ ID NO: 7282 - DNA, 334 bp, Homo sapiens
accttcttggctaaccatgatgacagtcggaccctgtatgccatcccaggcttggactatgtcagccatgaagacattctcccctacacctccactgatcaggttgccatccaacatgaactctttgaaagatttcttctgtatgaccatacaaaagcacctccttttgtggctcgggagacgctaagggcctggcaagagaagaatcacccctggctggagctctcccatgttcatcgggaaacaactgataacatacgtgttactgtcatccccttctacatgggcatgagggaagcccagaattcccacgtgtactggtggcgctactgta

SEQ ID NO: 7283 - DNA, 620 bp, Homo sapiens
atttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattatta

SEQ ID NO: 7284 - DNA, 703 bp, Homo sapiens
gcggccgcatcttttttttttttttttttggagtcctgatgctttgaactatggagtgagccgacatcactctgggacgattcctgtttgactgttggtgtgactatggccggatgcggaatgcccgtcgtgtgtagcgtatgatgtggtgggaccatatggggagggaacctggacatggaagcattgacggtcagagctgtggggtaggggtgtctgaatcctcctgtcgtgattgggtacactggttgaccttgctgtggtactaaccatcctagcggatgggggatttgtcctacggtgccaggcgatagtgggtaatacggggatatatctggagggtgcggaggccgtgggattcctgttttggggtctacgtcggctggtaagtgtggaggtgggtttcccggcgtgaagtgttcattgctgtacgtgataagaggcgtgagggggtggacatggtgagggtgctgcaccactggcactttgttagagacaatgtgtgccggtgatggggaccgggcatccttgagggcttgtctactctggaggctccctgcctggacatcaagccctcgtgccgaattcttggcctcgagggccaaattccctatagtgagtcgtattaaattcgtaatcatgtcatagctgtttcctgtgtgaaattgttatccgctcacaattccacacaacatacgagccg

SEQ ID NO: 7285 - DNA, 448 bp, Homo sapiens
ttcggcacgaggtatctaatacaatcaagtacaatacttcctttaggtgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaagcttaactttggtataggccaagtcagggagaaagtagagaaagctgtcatgccacagacttctttagtggagatcatttcctttttaactttgttcaggttgcccttcaccatggatacagtccggtacccttaaacatttaagggctgttttttttttctttacttgaggttcagctgggtattaaccaaacttaaattttttttccaaacgttttaaaatttacttaaagcaaaatgaagtcttttcccttg

SEQ ID NO: 7286 - DNA, 529 bp, Homo sapiens
  misc_feature 526: n = A,T,C or G
caaagaaattttaaaaactagttttattaatattacttgaaagagaagacagaattacactttgcgaagaggccatgaaaatagccactttttatggaagagttcagagtgcctcagaattggaatgctttcagttcatggaggggggtggatatgccacagaggagggagacacagacactgtactcacatcgttagtttggagaagcaacatatgagactgtgagcaatcagtgcaaggcagcaaaaaattgattacatgatgccatgtggaatccaagagaaaaggaacacagatgaaacaaaacaataaaaatgctcctttttctttcccaactattgtaaaactgaagaacatattttgttttcccctcaaagcaccaaacactgaaaaataaggagtgttgagagtgaacagagggattagtttaaaaaaaaaaagtaatagggaaaattggagtagttgagaaagattttataaggtgtgggttaagagaagatgagggttcattcatttattcagcanatg

SEQ ID NO: 7287 - DNA, 431 bp, Homo sapiens
tggttagggaccttgggggttgattctggggcaagttttttgacagggatctttgtaagcgggtttccttgaccctttggctcacaaaatctttgtctttggtagaaggcaatgccagggttcctgaaaaggccctaaaaaaactggacggggttcttcacatgcgggggaaaaaggaaacaaacccctccccctttttgaattttcggccgaaagggggtcattttttccccctgaccctgaattaagggatcatgtttcctagggggggaaaaaaaagtaaaatgtaaaagggaatgtagggaaaaataggttataaaagtttcaaaggaaaaatcttttaaaacccctgtaaggaacccccaagtgaaaccctttttttcctttttttttttttttttgggggcaaaaattttccaaggggaaaaggg

SEQ ID NO: 7288 - DNA, 523 bp, Homo sapiens
ccaaaagactctcgctgtccctgtgctgctggtatttcattctctgtaacttcagttctggtgttttccttgagtatctacttggcttctcgtggtttttcccaccccagctgccccagcacgcgggacccatagcacaccctcttgagggcttgcctaggttgctgaaaacagggaggcacctggtatctcgagtgcctgcagttgcaagtatgtttacacctggtgtccagttttgtattttaaaatgtaatccatttttacttcagctcatccaaaagcagccagcagaccggttgactgaggccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctgga

SEQ ID NO: 7289 - DNA, 110 bp, Homo sapiens
gatttgtcacgaatgggaagccaagtgccatcttcaaaatttcaggtcttaaatctggagaaggaagccaacatccttttggagccatgaatattgtccgaactccatct

SEQ ID NO: 7290 - DNA, 405 bp, Homo sapiens
cagaagggattccacattggcaagaagatgaggaggcccgcctactaccacactgttagcatacttgaatgtgggaggaaaatttaacaacagcaacaaaaaatccaaacaagcatactttttgatacagtattccattctaatcatttatcttggaaaaatgcttcaacagggatgcaaatacacatgtatgaggctatttattaatttttaaattagttgtataagcaaacaattgaaaacaatagaaatgctcagcagtagaatacaagtgttaaaaaattatgccatatccagataatagcatgccatgctgccattttgaaaacttgaggccagtctgtaggtgctgacacagatccatgtctagaacacattcatcaaaaaaaatacaggctgggagag

SEQ ID NO: 7291 - DNA, 484 bp, Homo sapiens; identical to SEQ ID NO: 2212

SEQ ID NO: 7292 - DNA, 601 bp, Homo sapiens
ggttttatcacatatactgatgaagagccagtaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttcttt

SEQ ID NO: 7293 - DNA, 427 bp, Homo sapiens
gaaagaggcaagttcctggtgcaaaggtggctctgcagcataatttaggcattggaggagctgtggttgtaacactctacaagatgggttttccggaagccgccagttcttttacaactcatcaaattgaagctgttccaaccagctctgcaagtgatggatttaaagcaaatcttgtttttaaggagattgagaagaaacttgaataggaaggggaacagtttgtgaagaaaatcggtggtatttttgccttcaaggtgaaagatggccctgggggtaaagacgccacctgggtggtggatgtgaagaatggcaaaggatcagtgcttcctaactcagataagaaagctgactgcacaatcacaatggctgactcagacttcctggctttaatgactggtaaaatgaatactcagtcggccttctt

SEQ ID NO: 7294 - DNA, 507 bp, Homo sapiens
acagaagggatcacttaatttttaccttattttggctctaatttgaataagctgagtaaaaccaccaaagatcagttataggataaaatggcatctctaaccataacacaggagaattggaaggagccctaaattgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcgttttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctac

SEQ ID NO: 7295 - DNA, 542 bp, Homo sapiens
acagaggggggaattcttcctgttctttgaagtattggatgcattatttctttaactatatcatttagttatttcactaatagaggctgccttccatatctcagagttgtaaggtttatgtgtatttttaggtgatcctttaaagcactttaacagtctcacattaagagcaagctgaagctgggcatggtggcttgtgggtgttatctcagctacttgggaggccaaggaaggaggattgcttgagcccaggagtttgtggccagcctggacaacatagtgacacccctgtatccaaaaaaaagaaaaaaaaaaagacaagctgagtttgcctaggtaatttaaaatgccaacattcctatagaacaagccttctgcttaggagttgataaaccagaactagccatccactgtcctctggaaatttcttcacagctgagactctccaggacctttgtaaaacttcaccttgggcaggcgcggtagctcatgcctgtaatcccggcactttgggaggctgaggcaggcggatcatgaggtca

SEQ ID NO: 7296 - DNA, 512 bp, Homo sapiens
  misc_feature 469: n = A,T,C or G
gaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatntctggccccaaagtggacattgatgcccctgatgtcagtatcg

SEQ ID NO: 7297 - DNA, 525 bp, Homo sapiens
acagaaggggaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattct

SEQ ID NO: 7298 - DNA, 302 bp, Homo sapiens
gccgcgtaaaagtcagcatgctgacaagggactgtagatttaatgatgcgttttcaagattacacaccaaaacaatatgtcagcttccctttggcctgcagtttgtaccaaatccttaatttttcctgaatgagcaagcttctcttataagatgctctctagtcatttggtcttatggaagtaagcctcatgtatactatggagagtcttccaggtgtgacaatcatgatatacaagaacaaacgtagtgttgggatctgtttggagattgtgatgggaacaagttcatttacttaggggtc

SEQ ID NO: 7299 - DNA, 529 bp, Homo sapiens
attccattaattgtgtaaataattgtataaatatattagtaatgagtgggaatcttactatcttaattgtggtaggaaaatgtcagaattattctctaatgtttttactacattaaaggttttcagagccagtcttgcttcttttcttttttttttcgagacggagtttcactctcgttgcgcaggctggagtgcggtggcatgatctcggctcactgcaacctccacctcccgggatcaagcgattctcctgcctcagcctcctgagtagctgggcttacaggcgcccgccaccacacccagctaattttttatatttttagtaaagacagggtttcaccatgttggccaggctggtctcgaactcctgacctcaggcgctccacctgcctcagcctcccagtgttctgggattacaggcatgagccaccacgcccggctccgtctttttttgtccatgcacacacacacccacttttgtcctttcagtattattttgaaagaaattctagatgtaatattatttttg

SEQ ID NO: 7300 - DNA, 351 bp, Homo sapiens
ggcaaggtgccattatcccttaaacatgtcccattaggagtaaaaggctgagaatggtgtctgtgagttgagcttggtaaacccaggagggccccaaagatatgattttctcaaacattgtctctcaaacatctctggagtgctcctctcagaaattttcctggaattatctgcatgagtttggatctctatcttgttgaggcctcattggtggatcctgaggtgctcttcacctccttcttgttcagaaaatgcatgtaggttcctctctcccaccagcttttcatcgtagtccttgattaaaagggcctcacctatggtcttactttttttttttttcctggggggtgg

SEQ ID NO: 7301 - DNA, 573 bp, Homo sapiens
acagaagggacacggcattttgttttcatcagtctttattcctgagtaccaccagcaaggcaaagcattgctcataaataatactgactgagacagaaagaaaaaatgtaagattgaaaaagcctgggccggacgcggtggctcacgcctgtaatcccaacactttgggaggccgaggtgggtggatcacaaggtcaggagttcgagaccagtctggccaacatggtgaagccctgtctctactaaaaatataaaaattagccaagcgtggtggtgggtgcctgtaatcccagctactcgggaggctgaggcaggaaaatcacttgaacctgggaggcagaggttgcagtgagccgagatcacaccactgcactccagcctgggcaacagagcgagactccgtctcaaaaataaaaaaaagaaaaagcctgtctgggcatggtacctcatgactgtaatctcagcttttggggaggccaagtaaggaagatctcttgaggccagaagtttaagaccagtctgggcaacccgttttgtagagtgacaccacatctcgacaaaaaaaattttttt

SEQ ID NO: 7302 - DNA, 529 bp, Homo sapiens
gggaatatctgtggaaaattaattaaagcagttatgaggatgctgcatttttacatgagctaagcctcatcttccaggtctacggggcccttttgcgttgcttctactcatacttaatctgtagaataggaattaaatgcctttgatgaattttgctctgaaagcttcttttttctgacagatcaaagtcaacctgattttctcccttcatgttacttgccatttatctttttgtgtgcctcacatagaagtgagcaaccatttcctttatttgttgtattagaaagataagaaaatgcaatgcttttagaggtgatgttatataagttgtcaaaattcagagaacaggaggatgagtgacttgaatcagattatttgggggcacttatttaatgttgaaggcatttattttatttactggactatatatatataacacacacagtaaaaagcagaggtcaggctgggcatggtggctcatgcctgtaatcccagcactttgggaggccgaggcaggcggatgccctga

SEQ ID NO: 7303 - DNA, 518 bp, Homo sapiens
ggaagttctgcgctggtcggcggagtagcaagtggccatggggagcctcagcggtctgcgcctggcagcagcttcacaatagccttgaaaaccaacagcctcacaaatcacagttactttgaaaaccagcggccttgcaggcactgaagaaggcagaatgggtttaagagttctccaaaacttccagctgcagagaattgttactatttgacttgtctgacagttcgctggaaaccccactcacagggcttatcttttttcacctgacttggagtttattcactgcaaacagtgttttccctggtgcatttgttgaaaataatcagcagcacttgtttgacataacatcgagtgggtaacagctgggtcaaacaagaagctggggaatgagatgtccatcctgacatctggaaagctctgacatatttctagaatgtaatatgtgtaaggttggacacattttccaggaaaaacctgagaggtctctaagctctcacctcacatttagtctctgtccg

SEQ ID NO: 7304 - DNA, 66 bp, Homo sapiens
cacggcgttagtggtttgtcctcttaatactgctttgaattggatgaatgaatttgagaagtggca

SEQ ID NO: 7305 - DNA, 69 bp, Homo sapiens
gacgacagaagggtacggctgcgagaagacgacagaagggtacggctgcgagaagacgacagaagggta

SEQ ID NO: 7306 - DNA, 617 bp, Homo sapiens
gggacaatgcacaagttattctggtggggaacaagtgtgacatggaggaagagagggttgttcccactgagaagggccagctccttgcagagcagcttgggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcaagatgagttgctgctattctttgcctgcccctggggttctctgcagatggtcccagtaatagatactcagcactagactaacataacaggtcactacacgggtgcagaatcactttacaaaagaagactctgttttacgaaggggattcactacagggacttagagaacagtctcttttctgcctttaaatgagagttcctccatttacc

SEQ ID NO: 7307 - DNA, 543 bp, Homo sapiens
gggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcg

SEQ ID NO: 7308 - DNA, 524 bp, Homo sapiens
gagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaagatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggct

SEQ ID NO: 7309 - DNA, 81 bp, Homo sapiens
tacataaatataccttgtatgcaaacgatgataaactagtcaggatgagcagagctgcctgacctcttgatttctgctgca

SEQ ID NO: 7310 - DNA, 527 bp, Homo sapiens
ggagaagccacttcccctctctggatctctgtttcactacctatgaggagattaaactagactgtctataagagtccttctctgagttgttctctgatcttggattctaaaggctggcacttgtatgaaaccagctgtcctgctttctggaaagagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgat

SEQ ID NO: 7311 - DNA, 588 bp, Homo sapiens
taacttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggat

SEQ ID NO: 7312 - DNA, 436 bp, Homo sapiens
aacatgcccaaagttacacagctgataattggttaggctcaggatttgaaaccagccaaactgagtagtaattatgtgtttacctgttatgctcttatttccgaggaatagatgacagttctcactagagatagccaaatttgtgtgtttgtgtatgtgtgtgtatgtgtgtgtatgtgtgtgtgtgtctgtttcttttttttttcccctttgtttttgaaacagggtcttgctctgtggcatgggctggagtgcagtggcactgtcacagctcactacatccttgaccttctgggttcaagtgatcctcctacctttacctaagcctcccaagcagttgggactgcaggtgcatgccaccatgcctggctaattctttaattttctgtaaaaacagggtctcattatgttgcccaggctgatctgtaactcctga

SEQ ID NO: 7313 - DNA, 584 bp, Homo sapiens
acagaaggggtacctttcctatagattctgtagcatttgagtgtggcaatattttaattgtgtatagattactaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtc

SEQ ID NO: 7314 - DNA, 492 bp, Homo sapiens
taactccctacattttagttctcacatctgaaaaaatattgagcatgcatatgccatagaattattgtaatgattaaattacacatgtaaattgtataatacacatagtgtctggcacaggatcattcacaataaaatttttattcaatgagtgagtattatcgctttctgtaacattctctagtagccctttctaagctctgcttcactttacatcattacttttgtctagtccttgacattccacctgttccggctttgacttgcttccccagatagtgtacatctgtgtctgcttcaaagcctcattctgttatgttctttaagagttatacctagaattgggccaggcacggtggctcacacctgtaatcccagcactttgagaggccgaggtgggcggatcacctgtagtcaggagttcgagaccagcctgtccaacatggtgaaaccccgtctctgctaaaaaatacaaaaattggccggtgtggt

SEQ ID NO: 7315 - DNA, 524 bp, Homo sapiens
attacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgc

SEQ ID NO: 7316 - DNA, 541 bp, Homo sapiens
gataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtaccccagccagggcaagagagcgagaccctgtctcaataaataaataaataaataaataaataaataaataaataaataaataaaaacaaagttgattaagaaaggaagtataggctaggcacagtggctcacacctgtaatccttgcattttggaaggctgaggcaagaggatcactttaggcctggtgtgttcaagaccagcctggtcaacatagtgagacactgtctctaccaaaaaaaggaaggaagggacacatatc

SEQ ID NO: 7317 - DNA, 241 bp, Homo sapiens
atgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatccca

SEQ ID NO: 7318 - DNA, 254 bp, Homo sapiens
gcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctct

SEQ ID NO: 7319 - DNA, 473 bp, Homo sapiens
gggaaatccagtaatttcttgagcagaagaaagggaagtggaattactgtagaaattatgcatagttttatattatctgtgtagtagcctgtttaaagtgatcattgctagtgcatggtatagaattacaaacttgtaaatacttctcaagattgccactttaaaaaaaaaagcaaaaagagctctgtagccctatttttttttttatttccaacaggaaatttgttcttgtttcaaaatgggggaacacccattattctctgttggccacatgaatgtcatccatttgtttattgcagcaaaaaaaaagtgaaaaatggttgatacaggggcaagctgttccttttaggttactttaaaaagtcatggaatttcggatatccaaagaaagcttaaggaatactctaaccagtatatatgtttacagtatccagtttaaaaatgaaaatgtaatgtagttattaaaacattat

SEQ ID NO: 7320 - DNA, 463 bp, Homo sapiens
tacggctgcgagaagacgacagaagggtacggctgcgaggagacgacagaagggtacggctgcgagaagacgacagaagggtacggctgcgagaagacgacagaagggtacggctgcgagaagacgacagaagggtacgactgcgagaagacgacagaagggtacggctgcgagaagacgacagaagggtacgggtgcgagaagacgacagaagggtactggttgcttagaagacgacagaagggtacggctgcgagaagacgacagaagggtacggctgcgagaagacgacagaagggaagaccagcctgggctacatagggagatccaatctctacaaaaaataaaaaattggccgggcatggtggctcacgcctgtaatcccagcactttgggaggccaaggcgggcggatcatgaggtcaggaaatcgagaccatcctggctaacacggtgaaacctcg

SEQ ID NO: 7321 - DNA, 487 bp, Homo sapiens
acagaaggggactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttagaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcggggaggtcttgtcaacggaaaggggtccctatccagaccccaagagagcattcttggatctcttgcaagaaagaatttgaggcgaatcca

SEQ ID NO: 7322 - DNA, 533 bp, Homo sapiens
cgagggggaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttgggctggagtgcaatggcgtgatctcggctcactgcaacctccgcctcccaggttcaagcaattctcctgcctcagcctcccgagtagctgggattacaggtgccagccgccacacctggctactttttgtat

SEQ ID NO: 7323 - DNA, 91 bp, Homo sapiens
tccagagtgctcgatactgttaattacatctccattagggctgaaaagaatgacctacgtttctgtatacagctgtgttgcttttgatgtt

SEQ ID NO: 7324 - DNA, 339 bp, Homo sapiens
ggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtgga

SEQ ID NO: 7325 - DNA, 548 bp, Homo sapiens
gtctgcttcattcattttggctctatgtggtggcagaagggcttctggcatctccggacctttatgcctcccaggtccaaacccagccagaaaggagagtgagagtgctgagtgcaaaactctcctatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcctggtgtctgttttgtcccttccctctgtagaggagtcctgctatcactgcaggcaacggggctgccctgcagctcctgctgtttacatttcactcggtgtagccataggcagagacctcagggagaacctgattcggcttggattgagtcaggttccaccccagtccagtcagttgtggactg

SEQ ID NO: 7326 - DNA, 72 bp, Homo sapiens
gacagaaggggctttctggtctcggccgcagaagcgagatgacgaagggaacgtcatcgtttggaaagcgtc

SEQ ID NO: 7327 - DNA, 54 bp, Homo sapiens
gctgcgagaagacgacagaagggtacggctgcgagaagacgacagaaggggctc

SEQ ID NO: 7328 - DNA, 595 bp, Homo sapiens
acagcaggggttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgttgttcttatga

SEQ ID NO: 7329 - DNA, 78 bp, Homo sapiens
gagactcgaggtgtgcttaaggttttcttagagaacgttattcgagacgccgtcacctatacggagcacgccaagcgc

SEQ ID NO: 7330 - DNA, 70 bp, Homo sapiens
aagccctctggtcctggaggcaggatcatgtggtggattcttggcagtcagcagtctgtggagcttttgc

SEQ ID NO: 7331 - DNA, 458 bp, Homo sapiens
gcgccactgcactccagcctgggcaacagagcaagactctgtctaaaaaaaaataaataaataaaataaaataaaataaaactgccttgattaagtaccttcaaatcagtgattaactagcaactctagccctgaattctgaatcttttatttttccttcaaaaggtaactcttaaaccatcccttctacttaatctgcatattgtactgaggttatttatcttccaacgtttgccagttcccttaggaatacccttagcaaccgcctttccatacaaattgcctgggaaagtttaaggggatcaaatcccttgtaactaaacaaaatagggcttttgaatagaaatttaatagcaaattagattggcatcattacaggaggatgaatgaaacttttgttttctttacatttacagtagaaaagtcaactaactctccaatatacaatgagctggaag

SEQ ID NO: 7332 - DNA, 466 bp, Homo sapiens; identical to SEQ ID NO: 2233

SEQ ID NO: 7333 - DNA, 518 bp, Homo sapiens
gacagagggagcctggaattgggccgagcagagtggctcacgcctgtaatcccagcacttcgggaggccggggcgggcagatcacctgaggtcaggagtttgagaccagcctgaccagcgtggagaaaccctgtctctactaaaaccaaaaccaaaaaattagccatgccttagtggcacacacctgaagtcccagctacttgggaggctgaggtaggcgaatcgcctgggctggggaagttgaggctgcagtgagccatgatggtgccactgtgtactccagcctgggcagtgggactgagaccctgtctcaaaaaaataaaataaaaaaatcaaagttttttgttttaaagttgaactattataagcctaaatttccccacccatagttactttggaacctgtacaaatcataattgagcttgagcctctgcttggtgatatgacacttttggtagccaattctcatgaaatagaagtggcaggcacatagaaaatggggaaggcgccaggcgcag

SEQ ID NO: 7334 - DNA, 512 bp, Homo sapiens
ggacgacagagggggaatttcctttcatgttcagcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaaatatcaaaacattatgaagtcctggaaaagggcatctgaaaaacctagaacaagtttaactgcgactactgaaatgacaagaattctacagtaggaaactgagacttttctat

SEQ ID NO: 7335 - DNA, 255 bp, Homo sapiens
aagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaaggcgacagaagggtacggctgcgagaagacgacagaagggacagagggagaccccaactctttgaaaaaaaaaaaaaccccaggcccaggg

SEQ ID NO: 7336 - DNA, 528 bp, Homo sapiens
gggtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacggctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgt

SEQ ID NO: 7337 - DNA, 559 bp, Homo sapiens
gacagaaggggctcataggggagcttctagaaaggaaggacttattgtcttagttacttgatccacttccttacctcctgttcatgcaactttgcttgttttgcttctactaaaatggttctaggtgctgtgtggacaggtgatacaaaagcctgactcacacggttgacattctttcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagggtctcactctgtcacccaggctggagtgcagtggcgcagtcatggctccctgtaacctcaacctctcagactccagcaatcctcctgcgacagagacagagtctcactttgttgctcaggctggagtgcattggcacaatcttggctccctgcaacctccgcctcccaggtttgagcgattcttttgcctcagcctcctgagtatctgggatgacaggtgcc

SEQ ID NO: 7338 - DNA, 546 bp, Homo sapiens; identical to SEQ ID NO: 2234
  misc_feature 441: n = A,T,C or G

SEQ ID NO: 7339 - DNA, 56 bp, Homo sapiens
gacagaagggataatcatagatgatggaagcccagatggaacaagggatgttgctg

SEQ ID NO: 7340 - DNA, 171 bp, Homo sapiens
aatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagc

SEQ ID NO: 7341 - DNA, 416 bp, Homo sapiens
cgtggagtgacggtgccaccgcggcgcgattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggacagggtcttgctgtgttgttgaaattcatcttgatctcctgagctcaagaaatcctcctcagtctcccaagtagctgagattacaggtgccaaccaccatacctaattattggcttttatttttaagatttttgcatatgtgtggccgggcttggtggctcacgcctgtaatc

SEQ ID NO: 7342 - DNA, 547 bp, Homo sapiens
gacagaaggaggataaagcctgtgtttctttcctttatttcccagggtttaacaaataaatgcatatattctctccaggtggggaagaaaatcagcctaaacaaattaaagtggcagttgcttatagttaaggttgagtcagtttttccattgcatacaatgttttcaagaggcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatgtgagggataggagaaacataaggaatcatttggtctctcagttcttcacattctgcatgctctcttttctccccccttcagatggtcttgctgcattcagggcttttttaaagtcggaattctgtgaagaaaatattgaattctggctggcctgtgaagacttcaaaaaaaccaaatcaccc

SEQ ID NO: 7343 - DNA, 113 bp, Homo sapiens
gacagaagggaactggcttctgcttgtcatccacacaacaccatgacttaagacaaatgggactgatgtcatcttgagctcttcatttattttgactgtgatttatttggagt

SEQ ID NO: 7344 - DNA, 563 bp, Homo sapiens
gagctgtggagtggcgtacagaggtaagtcctggtctgcgtggaggtcgacgactccgtcgcagactacggacctgtgtgggtctcagccgccaaagaccccgtgcggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatga

SEQ ID NO: 7345 - DNA, 596 bp, Homo sapiens
aacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctc

SEQ ID NO: 7346 - DNA, 82 bp, Homo sapiens
gaatgttggtgatgaagctgagttcaggactcggtggaccctttgggaatgggtcatgaaagctgccatggggtgaggaaag

SEQ ID NO: 7347 - DNA, 587 bp, Homo sapiens
acagaagggtcacatagtcctcagggctcagtcttttgaggtaagtggaattagagggccttgcttctcttctttccattcttcttgctacaccccttttccatttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaaccccc

SEQ ID NO: 7348 - DNA, 581 bp, Homo sapiens
gcctttccgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagcgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataataca

SEQ ID NO: 7349 - DNA, 76 bp, Homo sapiens
gaaatgtgaagaattcacctggaactaagtagaaaactccatgctctgccatcttaatcagttataggtaaacatt

SEQ ID NO: 7350 - DNA, 71 bp, Homo sapiens
gatgcagcccatgagactgttcccattatgctggtaggaaacaaggctgacattcgtgacactgctgctac

SEQ ID NO: 7351 - DNA, 348 bp, Homo sapiens
atgacagggagatgaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaacc

SEQ ID NO: 7352 - DNA, 108 bp, Homo sapiens
gtacgggaaggcgaagaaaagaatagagaagatagggaaattagaagataaaaacatacttttagaagaaaaaagataaatttaaacctgaaaagtaggaagcagaag

SEQ ID NO: 7353 - DNA, 602 bp, Homo sapiens
acagaaggggacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaag

SEQ ID NO: 7354 - DNA, 148 bp, Homo sapiens
tttctctgttacaaagtggcaataataataatagcactcacttccaaaagattgttgtaggattaaatgattggataggttcaaaatgttaggaacagtagtattcaataaacatagttattatttgctatctttcccactactccat

SEQ ID NO: 7355 - DNA, 484 bp, Homo sapiens
gtatactggtttatggaactttatttacactcctctatcatgcaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacccttttaaatcctaaaaaacactggcagttatattttaaatta

SEQ ID NO: 7356 - DNA, 582 bp, Homo sapiens
gtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgcgtcgggtaatgcgtgtggctgaatgggcataaccactgtggcttcttgtgctgtagaagctcgttgacaagactgaggaggatttcaagagcaaccaagtaaagtcatgcattttctaattttgtgtatatggaatatatttttaaatagagatttttctactttagataatgtgttaatattgctattacctaggttaagcactattgtctgtgctagtaa

SEQ ID NO: 7357 - DNA, 573 bp, Homo sapiens
gtccactaccagccggccagccccccgcgggacgcctgcgtctacagcagctgctactgatacctatctggaaacaacaggcgagacctggagatggacctgtgatctggtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttct

SEQ ID NO: 7358 - DNA, 204 bp, Homo sapiens; identical to SEQ ID NO: 2243

SEQ ID NO: 7359 - DNA, 99 bp, Homo sapiens
ggagagtccttctccacaggcttgataaattcaatcaccaactgtgctgtcgtccctgactctgctactcccgttcttcctgctttcctgctccgtatc

SEQ ID NO: 7360 - DNA, 605 bp, Homo sapiens
acagaagggatggacaaggctgtgtgatacagacctaaataccatgttcaaaggagatgtaagcagtggaggctaaactgatgaggaaaggctggagtgagacttgaacaaataggattagataatacatggaataaaggattcagatagtttgagtgaaggatggaagtaggaatgaattaaggctggctgtggtggctcatgcctgttatcccagcactttgggaggccgaggcaggaggattgcttgaagttaggagtgtgagaccagtctgggcaatatagcgagactctgtctctataaaaaatttaaaacattagcaggctgtggtggcatgccagctacttgggaaactgaggtgggaggatcacttgaggttagtgatcaaggctgcagtgagccgtgattgagtactacactccaagcctgggcaacagagtgagaaccatctcttaaaaaacataacggggctgggcacagtggctcacgcctgtaatctcagcacttgaatgctgaggtgggcgggtcgcctgaagtcaggagtttgagaccagcctggccaacccggtgaaaccttgtctctactaaaaaatacaaaattagc

SEQ ID NO: 7361 - DNA, 566 bp, Homo sapiens
acagaagggaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcggagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaatccagggaaggtggtgggagatgagtcaaagctaagtagtggaagctgggcacagtggctcatgcctgcaatcccagcactttgggaggccaaggctggaggatcacttgagccca

SEQ ID NO: 7362 - DNA, 651 bp, Homo sapiens
atttttagaaaaatcattcttactcaaaaagtgtcctacttagaataagtccagtgtgaaagctaggtgagtgtaattttttatagtcttgtaaatttggtttgtaatttaaaatgccttctagacataattttaaatgtgaattagtatctttcctttcaaataatcctttgggcatgaagccaaagaaggacaggaaacatttttcacttccttctcccacattgcagtcgggaacagattgcataaaggaggactgaagagtagtctgattttctgtgcaagttgtacaaattaaaagcaaccaggccttcacaggctagctcctgatggaaataagatgtgttttcggcatgagctgtttttcttgaactttgtttacgtctagtttgtcaaaaagataacagacttttctctttataaatgtcttggaagaaactgatgcatgaaattcgaccagaatttcttcagagaaatgttttagtgacagttgtgcaagtagcagaatggttatagaaacctggccattgctccatgttcagcatgtcctggtcagtttacacttttatgtctgtaacccttgagtgcacaagtatgcaaaaatagataaattatccgccttcatggagcttgcataggtaaaccatatac

SEQ ID NO: 7363 - DNA, 334 bp, Homo sapiens
gacctgggaggggtgcccggatctgcttgctggggatgttttttttttcttcttcttcagttaaagcttactgttgggaattacgaaaaacgtaggcgaagtggtaatagagggaaaagctcttttactgagtaaagttaagttaagtttctcatgaaacctcctggtaaatgactttctaggtgaacttacattaggtgagagattatttttagtatcgcttttatattttatcagttgatgaatctcaaagtcttgccgtcttaaaaaagggctttttcatcgagtgcttgaaatgtaggtttgtgagttgatcaaaggcctcaaagcttca

SEQ ID NO: 7364 - DNA, 577 bp, Homo sapiens
ggtcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtgaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaagccttgacataagatctcatttgcagaaagcagattaaagaccatcagaaggaaattatttaggttgtaatgcacaggcaactgtgagaaactgttgtgccaaaaatagaattccttctagtttttc

SEQ ID NO: 7365 - DNA, 474 bp, Homo sapiens
tagattgtcccaaaggtggcgcatgaaatcaaagcaggagaacagtttcctacgaggtgtagcctgggaaagttgggggtgactgatggaaaggaggagtgaagctccgccctttccgctgctaggctgcgcccgaggctatttaaacccaccctggctggcctgtactcagatcttcgcggagcggatcagcggccggagcgtttggcggactctgcgtggacttggagctcacagcgtcttgcgacttggaagcggattcagaggacaggacagaacacttgggcaagtgaatctctgtctgtctgtctgtctgtctgtctgtctcattggttggttgatttccattttcttaaggggcacatacctcacaccgcacacacacaaacacacacacgcacacacacacacacacgcacacacacgcacacacactccttccttctgcgagttaaaacattagtaggggcccct

SEQ ID NO: 7366 - DNA, 327 bp, Homo sapiens
gacagaaggtctgttgttattttcctctgttaaaaaatatatatctttagatttagattatgtgtttttcatcttgtgcatttaaattttaaaaattatttttccttaagccttttgtaaaggacctttaatcctaaaattgaaccgtaacagcaggaaatatattggtatggggtagatctatgttgtaattatttgtatattggatagttgctaaagactttacttggttttcagttttcttttgaaagccattttaaatagattggtaaaaggttagttggaaaagacattttgagaaatattttgtaaatttttttttttttt

SEQ ID NO: 7367 - DNA, 469 bp, Homo sapiens
atcttcccccaaacataactcattacctccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtagagacggagtttcaccgtatgagccaggatcctctcgatctcctgaccacatgatctgcccacctcggcctccccaagtgctgggattacaggtgtaagccacctgcacccagccctccagatccaatatctttttcctccatcctttgccaaaccaggacttcagcttctggttactggtgcccacttca

SEQ ID NO: 7368 - DNA, 710 bp, Homo sapiens
ttcggcacgagggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccg

SEQ ID NO: 7369 - DNA, 425 bp, Homo sapiens
tgggcatgttttctttcttccttattaataaacggggccattcccaaaaaggatttaaagggacttcattcaatccccaatttttttgaaaatataaattaaatttccgggtaaaaaaaaaccaggaggaaaacagggcccaggaataaggctggggcaaaactgcttctttgggattttctacccttacaaaaaatagcccatttatgggctggcaggataaactcctaacaaaaaaggaccctcaaaacatgccatggaggaaaatacattcccatggaaatgcccctataaaactccataaatttccttttcctgaaacatgtttgatttctttttaaacattcccaagttctcattttaaaaatggccagggttctgggcagtgtattctactgaaaaactcaggctactaagttcctgag

SEQ ID NO: 7370 - DNA, 338 bp, Homo sapiens
agcttgcggccgcggttttttttttttttttttttttacccaaaaaaaaaaagggggttccccagaaaattggggggcaaaaaatttaaaaaattggggccccttttaggggggaaaccaccctgtttttggggttaaccccccttatttttttttcgggccaaataaaccccccctaaattaccctttttaagcctcaaggggttcaaccccttaaacctgaaacttaacccttttttaacccgaaataagccttttttggcaaaagaattggccccatttacacaaaacggggggggggccctttgaatggttcccctcggcccaaatttttggcc

SEQ ID NO: 7371 - DNA, 264 bp, Homo sapiens
tcggaacgaggtcaatcttagtttgcctccagttaatcttttatgcttagggattaaatgtgtggttttttttttgtttttttttttggaaaacggagtttccttttgtcccccaggctgaagggcaggggcccaatctgggttaactgaacccttggcctccggggttaaaacaattttcctgcctaaccctcccaagaagcgggaattataggcccccccccccagcccgggttaatttttaattttaagaaaaaagggggt

SEQ ID NO: 7372 - DNA, 440 bp, Homo sapiens
gaatggttaaaaattcatttttaatagtattgctttaacatagacatgctaattttctcagacaatttagaacagaattgggacagtagtagcttcccttcttctccttactctcctagcctctctctttgaaagacctaagagccttgttcttcatagcaggtgctgatgcccaaagggcgattataagaatcctatagcctccccccctccccgccacacacatgagataataaagtaaatacagagaaaatggatggaagggagggaaagcactcccagcctttgattcttggtagttatgttcaagtggggcacttctctttgaaaagtgaaaatgtttctcacggtacagaatttatgggcagacaaggagcagacttaactgatcccagcaaacagttccttccttttcctaatccctggctgcttattttagc

SEQ ID NO: 7373 - DNA, 205 bp, Homo sapiens
cccccccccccggggggggttttttttttttaaaaacccccccctaaccctttttttcccaattttttttgggggaaaaaatcccctggaaattttccccttttaaaaaaaaaggccccccccccccattttaataacccccggggtaaaaacccttaaaattttcccgggaaaaaccaaaaggggaaagggttttttttttttt

SEQ ID NO: 7374 - DNA, 352 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcaacaaggactggactttctatctcttgtactacactgaattcacccccactgaaaaagatgagtatgcctgccgtgtgaaccatgtgactttg

SEQ ID NO: 7375 - DNA, 121 bp, Homo sapiens
ggttcatctcttcctagtaattggcaagacatctccctggaagatagtcgtctaaagttcaatcttctggctcatttagctgatgacttgggtcatgtagtccctaactccagactccacc

SEQ ID NO: 7376 - DNA, 531 bp, Homo sapiens
actgaaaaccaagatatcttacttctctacctacaaccttctttgcataaaatgatctaatgcaatccatgtaaaatgatatcaactatagaataagccagccaattttggaataaggagaggtattaaaatagattgctttgatttaagtctcctgaacggtaggttacattgaggctctcgtcggagcactggccagccggctttccccttcattccacgtgttgtaatgtgttaatatgcccagctgacgtttttgcctgtttcttaatttgacatcaacaacaagatcgagttctgacgctctgcaggggcgatacgcagctcctgaattggaggtaagttcatttccttttcctgtcctgcttcatctcagaagatccatttctcaagagggccttttgtgtttgtgtctttatcagtctgcattccgtgatcctgtttttctgctgaggaaagatttttgtatagaaaaataaatgctggccgggtgtggtggctcacgcctgtaatcccagcactttgggagtc

SEQ ID NO: 7377 - DNA, 145 bp, Homo sapiens
ggaaaaaccttgtagagagagtaaaaaatttaacacccatagtaggcctaaaagcagcctggccaacatagcgaaaccccgtctctactaaaaatacaaaaaattagctgggcatggtggcacatgcctgtaatcccagctactc

SEQ ID NO: 7378 - DNA, 116 bp, Homo sapiens
gcctgtggtcgatgacctctcggtagtttcaaagggggctggagggggatatttgacttgttttttcgaaatgtagccttctaaccctcaagtctttaaaagctgggtggactctt

SEQ ID NO: 7379 - DNA, 343 bp, Homo sapiens
gacagaagggagctactcgggaggctgaggcgggagagttgcttgaccctgggaggcggaggttgcagtgagccgagatcgtgccactgcactccagcctggccgatagaatgagactctgtctcaaaaaaaaaaaaaaaaaaaaattaaaaaaaaaaacttaaaaaattgtttgtaaaatttgaaccaggtttttttttggggaaatcttaaaattggggggggaattaattttttttcaaagcccttggggcttttaaaaatttttttaaaattttttccctttttggggaaaataaaaaagcctttccctttcccctttttttttttaaagggaaaattt

SEQ ID NO: 7380 - DNA, 517 bp, Homo sapiens
atgtgcacattctttgggagggtgttaggactctttcggttgcaagtgtcagaaactcaactcaaaggagcttaaacaagcaccagaagttaccgggtcacacatctgagatgcccaagggagctcccaatcaagctggatcagcgagtcaaaccgtgtgctcaggaccctttcttgctaggtcatctccctgtggggagaccaactgtcccagtttgcccaggtctgaggggcagtcctgggcatgggaccttgatgggtacaaccaggtcgagatggtccccctatctctctgcatctctgtgctggcttccatcaggcaaattctccccagaaagccagaagtagctccaagtgtacttgcttttcacagtggttactcctgggggacaagaaatactttttcctgagagttccagcggcagcttaagggagacctcagattggccctgcttggtccaaattcccatccctggttgggcacggtggctcacaccggtagtcccagcactttttg

SEQ ID NO: 7381 - DNA, 531 bp, Homo sapiens
gggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatcttttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgc

SEQ ID NO: 7382 - DNA, 473 bp, Homo sapiens
gtggagtaacagacagtcctcgtgcttggaattgagtctagtcttggcaattcttgtgggtccatgaacccgcaggctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttaaggcaatagtagccttttggtattgccactctta

SEQ ID NO: 7383 - DNA, 247 bp, Homo sapiens
gagccaaaggcagcgcatatggtttgtcgggcgccgattcctacaaagatgctgtccggaaagccatgtttgcccggttcactgagatggagtgagagagagagagagagagatatgacaaggagcacaagaagtggtccatctcccgaattcgctgttaccgcctgtctctttaagggcatgccttgtgctgttaatagatcttagggtgaaccacttcattctgcagggttctccctcccacctt

SEQ ID NO: 7384 - DNA, 450 bp, Homo sapiens
gaatcttctgtagtgttttattcttggtgtttttctttgggacctgcatgctttctggcctttgctcctgctgagtaggcagacatatctggagaaaaccatggagtaaaggaaaagctttggaatttaaaattgatttatgtggaagctttttctgtggttgaaaaaaagtaaagaaaaaccctcctttctacattaccaattcccggcaacagtaagccaaacctgttgtatttgggagcaggcctgggtgcatggaaactgctcagaacagggaggtcaatgccattatgataatccagtgacttccatgggaagccatcattgagaaagggtacttgtgcagatctaaaatttggaacaaaacaccctgaagatggccaaactgatataacgttatgtaccttggtggagtgtcttggtctgtttgtgttgctttaaaggaatact

SEQ ID NO: 7385 - DNA, 535 bp, Homo sapiens
acagaagggggcaggctggggatcctggggcaaatctctgctgtcgtcagcatctgccacagtaggtcatggattgacggcagtcaaggaaaaagcaggagccactctacggattcattgtaaattctggatcttctgaaggagcccaaccaaatactgaaaacggagtccctgaaataacagatgcagccacagatcagggccctgcagaaagcccacccacttccccttcatcagcctctcggggtacgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctgga

SEQ ID NO: 7386 - DNA, 550 bp, Homo sapiens
gtaagaatagatttctcatggctctaaaaattattcccaagaataccttacttggttcaaaagcagactgtttctctccatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgttttattaaaccgacagtggtgtcccagagaggaaccataaataaaatggaaatctggtgctgtgataaagtaataactagcattaatgagacctggttttcctttcagaaagtccagtatacctgtaacaaaggttaaagcaatttatatttaatttgcattctgatgttaacatttaaacagcaattctaacaaaaatgcatcgagtctaattcttacctcta

SEQ ID NO: 7387 - DNA, 521 bp, Homo sapiens
gtcttgtaggtgctacatatttattaaaatttttggttgtaattttaagctcactgcaggcagaaaggaatcattaacatttatattcttttttagtctgtatctaaatgatggtatattttaattccagatatttactttatactgcagtaatgctcgtcatattttgcaaaatttatgttgttcttttatttggaaatataaggcttttttagctcttgaaatctatattatagtcatataattttattatgttttgtggtaagaagtgcagcaacatattgagaacataataaaactatcctgtatttttaatgattatttattaaattcctctcattagagcctgtatttttaatgattgtaatgtattttctgtataattttactgcaatttattaaattctaatgacttaaattgtctgcttttcatgagtgcacacagttgaatgctgtagatatctaaagaattatttttcggccggttgtggtggctcatgcctgtattcccagcaccttgt

SEQ ID NO: 7388 - DNA, 484 bp, Homo sapiens
acagaagggagaggactggttcgggagtgcttggcagaaacggaacggaatgccggatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttact

SEQ ID NO: 7389 - DNA, 562 bp, Homo sapiens
acagaagggaggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaattgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgc

SEQ ID NO: 7390 - DNA, 413 bp, Homo sapiens
ggctgctggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatg

SEQ ID NO: 7391 - DNA, 124 bp, Homo sapiens
tgtagatcacatgggaggacagcatcttcttccctgccatttcagatataattggagggagaatttcaggtcttagactataaggatagaatccctttgcttttgcccttgatcacatgtatac

SEQ ID NO: 7392 - DNA, 72 bp, Homo sapiens
gctgcgataagacgacagaagggtacggctgcgataagacgacagaagggtacggctgcgagaagacgacag

SEQ ID NO: 7393 - DNA, 376 bp, Homo sapiens
tcctccgtaaatgttcactcttttgtgatcattgtgccttctgtgatttatgaagtgtctcttctgagttaattcttttaaaaaaaaaagtctcctccaacagacacggacccatcagcaggtcactgcctaggatctcaacactagagatcagggagtggcatcagcctctcccttttctaaattggactgggggacggagggttgatgtcatagcaagattgcagccttcactaaattaatgaggccaggttggatcctgtttaaaagaactggagacaggaagcagcgggggaatagatggggaaagaggaaagttccttatgatgcaagatgaatagtgtgtgtgtccagccccagtgctgtgacggggatg

SEQ ID NO: 7394 - DNA, 433 bp, Homo sapiens
ggctctgggaagagagtttgacgaagattcagatgaaaaggaacaagaggaggatacatatgaaaaagttttgatgatgagtctgatgagaaacaggatgaagaatatgcatatgaaaaggggcttgaagctgctgataaaaaggcgagaagaaggtgatgcagatgaaaagctgtttgaagagtcagatgactaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgcgtggttttgggagtgttgaagaagggcccctatccactggcagcagctttattctcagtagcgatgatgatgacgatgatatttaatccctt

SEQ ID NO: 7395 - DNA, 99 bp, Homo sapiens
ggagccattgtggctccggccggttgcgcgggccctcggaccctcaaggtatgcgagggttcgagggcacgagttcgaggccaacctggtccacatggc

SEQ ID NO: 7396 - DNA, 464 bp, Homo sapiens
cgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttc

SEQ ID NO: 7397 - DNA, 450 bp, Homo sapiens
ggaaatgcaaccaacacatcctatcagactgggtctggcccttaacttctctgtgttctattatgagattctgaactccccagaaaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacat

SEQ ID NO: 7398 - DNA, 562 bp, Homo sapiens
actagcatttgaaaatgaaggacaaattttgctcccttctctacaccaactttgtatgccatgggtttttaaaatgtgaaccctgcccatatattgtttctctgggcaccggccttcagtcatctaactcccttgcctcaatgaggaagtgaaactccagggctgtggagaccatgcagattccctgaataatcggaagggctcaccagtgatttcctgggtccccttcaagccttggctctgccaagccacagcttaactctgccatagcctctgactacagacagtcacagaggtttcattctccctcacctgtgcatgcacattgtcttgtctgttttctcttgctataaagggatacctgagactgggtgatttagaaagaaaagatgtggcctgggacagtggctcacgcctgtaatcccagcactttggaaggccgaagcaggtggatcacctgaggtcagaagctagcctggccaacatggtgaaaccctgtctctactaaaaatacaaaaattagctgggcatggtggcacatgcctgtaatcccagctactcg

SEQ ID NO: 7399 - DNA, 470 bp, Homo sapiens
gactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtc

SEQ ID NO: 7400 - DNA, 329 bp, Homo sapiens
gagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattag

SEQ ID NO: 7401 - DNA, 90 bp, Homo sapiens
tacggctgcgagaagacgacagaagggtgcggctgcgacaagacgacagaagggtacggctgcgagaagacgacagaagggtgcgggtgc

SEQ ID NO: 7402 - DNA, 55 bp, Homo sapiens
taaaaccagaattggaccttggatttttattttggcaattgtaactccatctaat

SEQ ID NO: 7403 - DNA, 579 bp, Homo sapiens; identical to SEQ ID NO: 2253

SEQ ID NO: 7404 - DNA, 549 bp, Homo sapiens
agatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgct

SEQ ID NO: 7405 - DNA, 613 bp, Homo sapiens
acagaaggggtacctttctagacccatcctcttgcaatcttggaccctaagaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgaggagtcaggccttgaaaagaggatagaccaggctgtggaggagtggaatattgagaaggctgaggaactcagcaaccagctagctactcgagagcttggtgtaaaaatt

SEQ ID NO: 7406 - DNA, 594 bp, Homo sapiens
gggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcag

SEQ ID NO: 7407 - DNA, 448 bp, Homo sapiens
tccggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaaattttcctctttttataatccatgaaattcgaaaacagaaaattattcaaagaataggcaaatgtcatgacagaacttagtgtgagcaagtcattgagaattaaaatctaacttttcaggtcagagagccttgaaatacttacaataaagttataaaggcctaggtatttttctttcttttttttttt

SEQ ID NO: 7408 - DNA, 581 bp, Homo sapiens
gaaggcccagacggctctcagatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctc

SEQ ID NO: 7409 - DNA, 504 bp, Homo sapiens
atgagtacgatttcaatagactgttcagtttttaatattagccatagcactggttagtatatctcagtagtttcatgaaacgtttcctgtattctaatctatttctgaaacattttgttttttttaattgtgtcttacagtcaagtttgtagattttcataagccacaattttaaatgatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagtataattagttgattttttcattttgttagaggtattttcactgaacaaggtcaattggttacctcagtattacag

SEQ ID NO: 7410 - DNA, 118 bp, Homo sapiens
gctttttcgcaacgggtttgccgccagaacacaggtgtcgtgaaaactacccctaaaagccaaaatgggaaaggaaaagactcatatcaacattgtcgtcattggacacgtagattcg

SEQ ID NO: 7411 - DNA, 225 bp, Homo sapiens
gttccccccaacactcccttttcttttgagacagagtctcactctgtcacccaggctggagtgcagtggcacgatctctgcttactgcagcctccacctcccaggcccaagtgatcccctacctcagcctcttgaggcactgggactagaggtgcatgccaccatacctagctgatatttgtattttttttttttttggaaaaaccagggttttccctttttgcc

SEQ ID NO: 7412 - DNA, 422 bp, Homo sapiens
ttactctgtacatattaaccttcactattcagatgaactacaactggaactggatctaggatatagggaaatgaaggaaagggggcgttggaatccagtagacatgggttggaacccaaactccagcaattgacagctgtatgcatggacatatttattgtttctccttaaaaagatttcctttttatttaaaggacttgaaatgccttttagttgtgcctgtaaagactgtgaatcttgcatttgcctgtgatccttagcagtagggtaagcccacatctggcatatgtgctggccaaaattaccctgaataagtgcatgacaactctcaatctgtttcttctttctgtaaaatgggaaagcgggcattgtactggacagttttaaggactctataaaaccatgtaggcaacataaaaaat

SEQ ID NO: 7413 - DNA, 430 bp, Homo sapiens
gatttttctgctagacagataacttttaatttttcaaatttggcagacactttttttttttttggaaaatttttccttccaaatatgggggcccaatgaaaaacccccccgcccttaatggccggggggcccaatgggccggggggggggggggccataagggggggagaaccggaaggggctttagggtggggtaaggggcgggccttttttgggggtgggcccatttttaaaattttcaccctttttttaaaaatttcaagggccgtttaagttttttacccaaaaagggcggcctttaaggggaggaatggggaaaacaaaacagggggagggaaaaccctgcgggttaaaatttccacggggggggcaaattttttttccggggggagggggaaaaaaaaaaaaaaactttttttaaaaaaaaaat

SEQ ID NO: 7414 - DNA, 521 bp, Homo sapiens
acagaagggcaccatcaccacgaagtattgaaaatctgttttctcttttactaagtgtctgcacggtcacttatgtatacccaaagccagaaagatatttttatctcagggaaattccagaaatggaaacatttttgtgtaatattgattcatttctgtctcaccaaagatgtgttttccacgtagcaaagaacatcagccccacgttatagggaacaagcgagtcccaaatcgtaccatctgctgagcactgagaaaggatatggacaagtcagtcagcattcacaattaagagaaaaacatctgtgctttggaaaatgttcttcaaggatagagaattgtgccctatgtccaccaaatttgcatgagatctttataagattagacagccagtggataaggccccttatctttcttcatggatggctgaggaaattctccgccttccctgacatcagctgcataactgtatttctgcctcgtggaaataaagtagatgatcaggcacttgcggtttgttc

SEQ ID NO: 7415 - DNA, 451 bp, Homo sapiens
ggtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccagtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactt

SEQ ID NO: 7416 - DNA, 121 bp, Homo sapiens
atttcaacagaaacatacataaaacaaggtgtattgttttgttttgttttgtttttgagacggagtctctctctgtcgcccaggctggagtgcagtggctcaatctaggctcactgcaagc

SEQ ID NO: 7417 - DNA, 493 bp, Homo sapiens
gatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaact

SEQ ID NO: 7418 - DNA, 603 bp, Homo sapiens
gacagaagggatcctccctgaccctgctcctagcaccctggagagtgcacatgccccttggtcctggcagggcgccaattctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccagccaggggaagggtcccttttgcattgccaagtgccataaccatgagcactactctaccatggttctgcctcctggccaagcaggctggtttgcaagaatgaaatgaatgattctacagctaggacttaaccttgaatggaaagtcttgca

SEQ ID NO: 7419 - DNA, 396 bp, Homo sapiens
ggtggtgtcagcatcctggtgtttggtcattctggtaggcgtataatggtctctcattttctttttctttccttttttttgaggcggagtttcactcttgttgcccaggctggagtgcaatggcgcgatctcggcttgctgcaacctccgcttcctgggttcaagcgattctcctgtctctgcctcctgagttcttgagattacaggcacctgccactacgcctggctaatttttggtatttagagatggggtttcaccatgttggccaggctggtcttgaactcctaacctcaggtgatccacctgtctcggcctcccaaagtgctgggattacaggcatgagccatcgcgcctggctgttttttgtttttgttttgagagtgcaccactgcacc

SEQ ID NO: 7420 - DNA, 503 bp, Homo sapiens
gacagaagggctgataaagacatacccgagactgggcaatttacaagaaaaagaggttttatggacttacagttccacgtggctggggaggcctcacagtcatggcagaaggcaaggacgagcaagtcacatcttacgtggatggtggcccgcaaagagagagcttgtgcagggaaactcccctttttaaaaccatcagatcttagccgggcacggttctcgtgcctcagcctcccaagtagcagagattacaggcatccgccaccacgcccggttaatttttttatttttagtagagatgggatttcaccatgttggccaggctggtctcgaactcctgacctcaagtgatgtgcctgcctcagccttccaaagtgctgggactactggtgtgagccactgcacccaacctctttccagtactcctgccatgagtaagaattttggaggtgtgttggggacctttgtagcgcaaggattcttgtagatctgctgacagattc

SEQ ID NO: 7421 - DNA, 67 bp, Homo sapiens
agacttttttcagataacatcttctgagtcataaccagcctggcagtatgatggcctagatgcagag

SEQ ID NO: 7422 - DNA, 563 bp, Homo sapiens
gctttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctc

SEQ ID NO: 7423 - DNA, 408 bp, Homo sapiens
gggagtgcaaaactctcctatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcctggtgtctgttttgtcccttccctctgtagaggagtcctgctatcactgcaggcaacggggctgccctgcagctcctgctgtttacatttcactcggtgtagccataggcagagacctcagggagaacctgattcggcttggattgagtc

SEQ ID NO: 7424 - DNA, 289 bp, Homo sapiens
tgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaggttttaatttttttcaaggtaatttttcaaacccttgtccttgggccaaaaggttttttttaaaaggggggttttccaaaaaaatttttgaaaaccggtttttttagggttcttttaagggtttttggggaatggggggggga

SEQ ID NO: 7425 - DNA, 469 bp, Homo sapiens; identical to SEQ ID NO: 2261

SEQ ID NO: 7426 - DNA, 290 bp, Homo sapiens
atcgtagacatgaaaggattcacacgggagagaaggcttatcaatgtaaggaatgtggaaaagcattcacgtgtccccagtacgttcgtatacatgaaaggacccactctaggaaaaaaccctatgaatgtacgcagtgtgggaaagcattatcctctcttacaagttttcaaacacacataagaatgcactctggagaaagaccttatgaatgtaagatatgtgggaaaggcttttgttctgccaattcatttcaaagacatgaaaaaactcacagtggagagaaaccc

SEQ ID NO: 7427 - DNA, 296 bp, Homo sapiens
ggaattgtatggtatttgagtaccgcctaggtgaaaagctgtttttttttttgaaacggattctcgttttgtcccccaggctggcttgcaggggggcaattttggttcattgaaagctccgcctcctcggcccttgccgttttcctgtctcggcctttcaagtacctggaactacaggcccccgccaccacgtcgggttaaattttttgtatttttagaaaaaacagggttccaccgtgttggccaggatggtctcaatctcctgacctcgggatccgcccgtctttgcctcccaa

SEQ ID NO: 7428 - DNA, 221 bp, Homo sapiens
gcagtaccagtggcagtcattggtcatcccctcttacattctacaagaaatatgcaccatgggacttaaacttgactaggatgcgtgccttgatgaactcaatctctggcaaagactcactgggttgaaggaaacatgaagggttgggaaagggaagcacaacaaaacaaaggcagtggaagtaaagtgcaagccagggagaaccaagcccaaatttgtca

SEQ ID NO: 7429 - DNA, 432 bp, Homo sapiens
gagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatcccaacctcgacaggcgaacaggatatctgaaggggtatactctagttgaatatgaaacatacaaggaagcccaggctgctatggagggactcaatg

SEQ ID NO: 7430 - DNA, 602 bp, Homo sapiens; identical to SEQ ID NO: 2265

SEQ ID NO: 7431 - DNA, 572 bp, Homo sapiens
attaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaaagtatctctgggtattgcat

SEQ ID NO: 7432 - DNA, 206 bp, Homo sapiens
gcccagctcctctgtggcaatgacaccaagatctcggagcagcccgtggttgtgcagagtacatgcacagacggacgtgcattccatttcctggtgttacagtagaacaccacagacctggcctcttaacaagtgtggcaagagtttggtctgggtggaatcatgccagctactctctcagcatttttggtgtctcccagtgataa

SEQ ID NO: 7433 - DNA, 273 bp, Homo sapiens
agtcctcgtcgtagcagtggggatggtgggaattcccagccccatcttctcccaggggtagtgacctgccacttcctctacagcttccgttcgggaattcacagggtctagtctgggactgtctaggcagctggaggaaaaagagggagctaagagtacaggaaaggatgggatgaaaataaccaaaaagaagattcacacttcttttgtttaaatttttatttttatttttatttatttaggttttggagacagggtttcgctctgtcaccc

SEQ ID NO: 7434 - DNA, 487 bp, Homo sapiens
atgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacag

SEQ ID NO: 7435 - DNA, 468 bp, Homo sapiens
agtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgactgtagcacactttggccaccaactcctgggctcaagtgatcctcctgctttggcctcctctgagaagctgggattactggtgcacaccaccacacctggctaattttttattttttttatttttggaaatagggtatggctatgttgccttgggcccgtcatgaactcctggcctcgggtgaccctcccgcctcaggcctccc

SEQ ID NO: 7436 - DNA, 412 bp, Homo sapiens
gggcgtccgccgcctccggaactaaacggggtgaggtcacattcggttatctctaacgttggaaaacgatggagctaacacccattatggagattaaccacttttcatcagttttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggccgtgtcccctcgctctgttgttccagctatgtcccctctgttgctccaactgcagctcattctgttagagttcctcattcagctggtcact

SEQ ID NO: 7437 - DNA, 541 bp, Homo sapiens
catgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttttctttgataacatgggagcagattctttccatgaaccatctgcttttaatgattttcagaggccagccatttattacatgatgtcattcagtgattggtatgagatgcaagatgctggaattacttcagactcaatgatgaagaacttct

SEQ ID NO: 7438 - DNA, 411 bp, Homo sapiens
acagaaggggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggagatttgaagagatttcctgggtgtggagtgtgactttccaaaaccagcttttccttgagctgtatttgttgtagcaatgtttaggagattgacttttgcacaactgctttttgccactgtccttggaattgctggaggagtatatatttttcaaccagtatttgaacagtatgccaaagatcagtaggaattaaaagaaaagatgcagttggtacaagaatcagaagagaag

SEQ ID NO: 7439 - DNA, 134 bp, Homo sapiens
gtttcaccatgttggccaggatggtctccatctcctgacctcgtgactcgcctacctcagcctcccaaagtgatgggattatgggcgtgaaccactgtgcctggctacactggtatttctatgtgtgtgctacc

SEQ ID NO: 7440 - DNA, 454 bp, Homo sapiens
tgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctc

SEQ ID NO: 7441 - DNA, 540 bp, Homo sapiens
ggccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttctggctagaggttcaaaaataaagaagctagtgtatccgcctggtttcatgggattagctgcctccctctattatccacaacaagccatcgtgtttgcccaggtcagtggggagagattatatgactggggtttacg

SEQ ID NO: 7442 - DNA, 291 bp, Homo sapiens
tacggctgcgagaagacgacagaagggtacggctgcgagaagacgacagaagggtacgggtgcgagaagacgacagaagggtacggctgcgagaagacgacagaagggtacggctgcgagaagacgacagaagggtacggctgcgagaagacgacagaagggtacggctgcgagaagacgacagaacggtacggctgcgagaagacgacagaagggtacggctgcgagaagacgacagaagggtacggctgctagaagacgacagaagggtacggctgcgagaagacgaca

SEQ ID NO: 7443 - DNA, 54 bp, Homo sapiens
gattttaaacatgtaaatacaaattttgtataacttttgatgacttcagtgaaa

SEQ ID NO: 7444 - DNA, 569 bp, Homo sapiens
gacagaagggtatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgt

SEQ ID NO: 7445 - DNA, 513 bp, Homo sapiens
cttaagttctccattttaatttatcccgtatgtgagatgaacatttctgtatgttatttgtgttgatattataaagttcattattcttatcagtaaagttcaaatgtcatatctggctttataatgccttttctaattcgaatggtagatgccaaatacattttgaaagacttttaaattttttgcttggtaaaataatgctgaggaaaaaatgttttgcacaattattaatctctaatgttaactcccaaaatactcacccaatcaaagaaacatcagacaaactcaaattgagggacattctcaaagtaatctgccccttcaaaaattaaaaatttgcctggagtaatttgttcttgagaaaatattaacaaacgtaataggttaaaggagattaaagagccatgagaacttactgccatacatgatcctgaattggaaacaggaccaaattctattcatacttgtatttcattcattctctcattcatttatgatataaagaacattaat

SEQ ID NO: 7446 - DNA, 275 bp, Homo sapiens
tcagactagcaagccctgcctcagcttttccccaacatggaacgctgttctaaaagcacccatgattcttttttttcttttttttcttttttttttttcaaaagggattttcctttttgtggctaaggcggaagggcaaggggggaatttgggttaattgaaacctccgcctccggggttaaagcaattttccggcctaaccctttgaagtagctgaaattacaggcttaatccgtggttcccacccccccttgttttccggatggaaaaaattg

SEQ ID NO: 7447 - DNA, 439 bp, Homo sapiens
acagaggggttcggcggccttggcctgttgcttcagcctgagctcggttagggcctcacttccctgcttccacacctcagggaggcctcggtgattttgccagagcctcagcctccatcgctctgtaacctgcgggtattggattgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagagtctcactctgttgccctggctggagtgcagtggcgtgatctcggctcactacaacctctccctgctgggttcaagcaattctcctgcctcagcctcctgagtagctgggattacaggtgcg

SEQ ID NO: 7448 - DNA, 584 bp, Homo sapiens
attttacattgcctttcctagttcatgctggtgctgccttcgtccatgcttgtgagtggaatccccatgctgtagttgctctgagaaataaccttgagatcaatggagtagcagatcggtgccaaatacactttggagataacagaaaactgaagctctcaaatattgcagatagggtgatcctggggctgattcccagctctgaagaaggctggcccattgcccgccaagtgttaaggcaggatgctggaggcattttgcatatccaccaaaatgtggaatctttcccagggaagaatcttcaggctcttggagtcagcaaagtagagaaagagcattggctgtatcctcagcaaattaccaccaaccaatggaaaaatggagctaccagggattctaggggaaaaatgctgtcaccagccaccaagccagagtggcaaaggtgggcagaatctgcagaaactcgaatcgccactcttcttcagcaggtgcatgggaaaccatggaagacacaaattctgcacatccaaccagtgaaatcctatgctccccatgtggatcacatagtcctggatctggaatgc

SEQ ID NO: 7449 - DNA, 335 bp, Homo sapiens
ctctccttgctggtttcatttgctcttatggcagacagtgtgctctggtggcgctggaagatgttaaggcgtatctcactgaggagaatggtcagattgcggtaagctttatctgctgcttcttctttctggtccccacccttgcagcagcctggctacccagccccaccttgagtctgccctggtggggttctgtttctctgttcctgctcatttaccttgtgtactttcttcacaggtgtttgatgccaccaatacaacccgggagaagagggacatgattttgaactttgctgaacagaattcctttcaggtaggatctgactccatgttgg

SEQ ID NO: 7450 - DNA, 388 bp, Homo sapiens
agactgggtatacagttttctccacatcaattttcagcatagggactctttcattattgccaaaagaataaaacctctaacattaccagcagacggacacactctgacagtaccaaacaatgcctctattttgcataaatatttcctgaaagctgtttgtcatctaagtcactccttgttctgggtaattgctataatcctttgctaagtatttcctgagtcttgtatctgacatcatgtttctacctatgaccaataaaggtgtatgccactcttttcagtaggagcttaattatagtgattactaagttttgctgtttagcaaaacttaacacaaggaacactcattctgctttcccccttttcccaaagccattcaccatgttgc

SEQ ID NO: 7451 - DNA, 562 bp, Homo sapiens
gacagaaggtggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgact

SEQ ID NO: 7452 - DNA, 50 bp, Homo sapiens
gatgaaactgacttttgtcttttggagaaaaaaaactgtactgcttgttc

SEQ ID NO: 7453 - DNA, 90 bp, Homo sapiens
gactttaaaaatcagtctgataagtctttgataagtctaataataataactgataagtccattgaatttgcttctgattactttttcttt

SEQ ID NO: 7454 - DNA, 348 bp, Homo sapiens
acagaagggatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaatttttttttttctagtatagggtacttaagcatttccacttttggaagaaaagtgtattagtattttatattgcatttcatttaaaaggacagtttttttttttttggaaaaccctt

SEQ ID NO: 7455 - DNA, 551 bp, Homo sapiens
  misc_feature 481: n = A,T,C or G
acagaagggatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgnaaccaaaaatacatggatctggtcatgttgaagaaccagcatcaccactagcagcatatcagaaatctct

SEQ ID NO: 7456 - DNA, 591 bp, Homo sapiens
ggccgcgggagtgcgccagcgccgcgcgtggggctgtggtggccgcggctctcaaatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaaaccatgtgaagtccaagtccgctaaaccatctactaacgttaaaaaaagcataaggaaaaagtattgcaaagttagctcctcttcctc

SEQ ID NO: 7457 - DNA, 119 bp, Homo sapiens
ttgaggctagtctggaacctttcattagagcaatatttggttattgcacttcatttttatttactaagaaatgcaatttgggaatttttaatctgttatgctttgtttatcaaccttga

SEQ ID NO: 7458 - DNA, 424 bp, Homo sapiens
caaaggaagacacagacggtcaaaaacgaccccatccgctcctagggtttctaattcccgtgacgccagaatgccttgagcacacatggaacttgccacactgagtgtctgggtccaaggaactgctgccctcccttccttctacttaactctgttcccagaaacctgatggtcaatgccagatcgctccccactgccgccagttcttgtgtgttgttggttcatttgcggttttcagcagtcagtgcctctctatccagtagaatagtgtatggacgtagcgaagggatgaaacagagaagttgcataacccagcctctttgatcatgttagaaatcacatcctcaggtctttccagcggagctccttcatggtcaagctctaagacacaacgagctctgttattcaagaaatcaattccagt

SEQ ID NO: 7459 - DNA, 519 bp, Homo sapiens
ttcggcacgaggttttgcattgccatgattttattattagtgtccaaaagggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttc

SEQ ID NO: 7460 - DNA, 229 bp, Homo sapiens
ttcggcacgagggtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaagg

SEQ ID NO: 7461 - DNA, 81 bp, Homo sapiens
aacgttttttttttttttttttgggcagggaggattttttggggggggggaattttgtttcccaaaaaaaaggaagggggg

SEQ ID NO: 7462 - DNA, 727 bp, Homo sapiens
gaataagcttgcggccgcaggaattttttttttttttttttgtaggtacaataaatctgattgatttttattacacatcttagtttagaatcacttttacattcctagacaaagagatgatacaaataaatatcaattgtaaaacttagagccccaagtattgattggcgtattctttgtctaaaggtagccaaagagaaggtcaagatcagtaataacttcaaggagccatgaagcccactgcctcctgcctgccccaggatcactcctttcataaataaccccagaagcatttcattcaggaaacaagggcaggcagaaaggtgacagatttctgaacagtacaaaacaaagccttgcgtgatagacaatcaccaggcccactattcttagccagttccctcagagcatttttagtatggcttttagagtatattaacagccccattttcgtccactgatggggttcagatggtctgaggtgttgtctccagtacgcctcaacctcaagtgggaaatgtgaggcagaactgatatccatgttaacagggaatcgacacttctcagaaacttggcaacgattctacattcagtgagggaggacttgtcagagtcagacaggaaaagcagagagcggcccacgccccagttgcagcactctggcgcccttggtcatggaggtgtgggtggagcaattcaagcagcatgcaggcattggacgggaaat

SEQ ID NO: 7463 - DNA, 487 bp, Homo sapiens
atctttttaaaaatatgtatttcagttgcacatgaaatgtactttgaaagaatgagctccaaagttctggggggctgagacaggcgggctgagtgaaatgatgaagaaacagtggctttcagtgcgggccaagagagtagtgagcaatggtcagttattgagctgtggagtgccttcaacaagggtttttagacacatccatctggtgcctcatcccagaacctcacaggcctagggacctgaaatgctccccatgacaaggcaaacttcatatcctcacatgctgagacagactcaactttcagtctggaactgggctgggtgtctgtcagtccacgccacccatatccggagtacatcagagtctgggttcagtggcagccactttcgctgccctctcctgccccacacctagcgctctgcctggcccctttgctgtgggcgtgaaaatctggcacccgggccgacagggagagagctcagtctg

SEQ ID NO: 7464 - DNA, 625 bp, Homo sapiens
agcttgcggccgcgcccgtgcacgagcagtccctggggtctgtagtggcctctggagagcccttctccccaggccaggcgggaaggcccccgctccggcctggttgaagtaggggaacgggtcccaacgcggggccgactcccttgaccctctgacttgctggcttcccttgttttacagtcctcggcctggcggaagttttgcatgttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctctccactgggtcgtggggctcctcatttcatcctaagtgagcccctccatcacctgtgtgttaaggaggcatttctttcccatcagtaaacacatttcgcctcttcggccgaggtaggaatataaaaggcccctggcctacccaagttttggtccagcaggggagccaggccgggaaagggccaagccgccacactcggcttgtggggcggtgtggtgccgtgatgcagctgtgggtttg

SEQ ID NO: 7465 - DNA, 53 bp, Homo sapiens
tttcatatatagcatgttgcctgtatgcagttgaactatataaagttcattgc

SEQ ID NO: 7466 - DNA, 96 bp, Homo sapiens
gtttctaaagttgcacctaaggaatctgtcacattttctgttgaatcatggtttttgtttttgtttttaacagatattccttctgatacggacttg

SEQ ID NO: 7467 - DNA, 488 bp, Homo sapiens
ggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaagattagttgagttccagctgggttttgggagaaaggagatgctaccaagtcttggatgttagggcgag

SEQ ID NO: 7468 - DNA, 557 bp, Homo sapiens; identical to SEQ ID NO: 2280

SEQ ID NO: 7469 - DNA, 611 bp, Homo sapiens
tagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactggtaaggtgctgacactggtatttatgaacggttacatcgaatgaatcctactaagcaagaaacac

SEQ ID NO: 7470 - DNA, 417 bp, Homo sapiens
atttcaagccactgttgaaacctcagtgtggcatcccatgagagccttttctcacagatggacacttcacagttaagtgtcattagtatgttaaagctaggaacctacccaaaagtacaaactcagtttactacatgattcccaaggatttttaataaattgtgttaaattccttgctgaatttaaggtataatgtatatctatctattcacccatccaaccaaaccaaccacagattcttcactcaagaaaatcaggtaagcttggcatgatttgccgttttgcctttatttttcttgctagtgcttttttataatatttattattttgttttagactgaggttttatgtcaaatctgtagttatcagcatatgacctttaccttttagacaacttgagaaatcttcacccccatc

SEQ ID NO: 7471 - DNA, 559 bp, Homo sapiens
ggcatttgaaggcaggaagatttttaaagatagattgaggttggtttaaaattattcctgtaaaccaacaataaagcgaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtatt

SEQ ID NO: 7472 - DNA, 475 bp, Homo sapiens
gggttgttcaagaatcacttgtatataccatatttcatttattcatccattgatgaactgtgaagcagcctgcttttggctgttgtgactaactaatgcttccatgaacatggatttacaaatacctgttccagttcctgctttcacttcttctgggtgtctgcaagtttaagaatcaaaattttaaacaaatcaaattggcactagataagttacttgtaaggtttgtatggaaaaataagcaagagtagccacaacttttctgaaaagaacagtaactagaaatcaggcttattagataataaaacagaaattaaaagggttagaatattgtggttgtggtggactggcagacggaaaatcactgacgccgaatagaaaatctaataattggctgggtggggtggcttacacctgtaatctcagcactttgggaggttgtgacgggagaattgcccgagcccgggagtttgag

SEQ ID NO: 7473 - DNA, 124 bp, Homo sapiens
atcatgccattgcactccagcccgggcgacagagtgagactctgtttaaaaagaaaaaaataagtatttgtaaatgtatatatatatatatatacacacacacacacacatatatatataaaat

SEQ ID NO: 7474 - DNA, 230 bp, Homo sapiens
agggtgaaatcccctaactgggcatgactggagaaaaaaggggaggaatatttttcagatgaagaaattaaatcttcatagatattaagtaatgcgcccaggcacagtggctcatgcctgtaatcccagcactatgggaggccgaggcaaataaatcacctgatgtcaggagttcgacacaagcatggccaatataatgaaaccccatgtctgttaaaaatacaaaaatt

SEQ ID NO: 7475 - DNA, 79 bp, Homo sapiens
ggactctgtccccacactcagaaagactcagctcactcaatgagagaatgtgatttactttatagaacgtataatcaac

SEQ ID NO: 7476 - DNA, 567 bp, Homo sapiens
gagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcgtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaacatgtctacaagaagatgtcaagaaagcagagttgcatctgtctacagaaagggccaaagttgataatcgtcgtcagaacatgga

SEQ ID NO: 7477 - DNA, 314 bp, Homo sapiens
gcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcc

SEQ ID NO: 7478 - DNA, 507 bp, Homo sapiens
ggtggttgattgtgttacttttcgactgtattctgtgctcttccctacaggaggattattcattcctgtttacttgaattcaggcaacatcatgtaacttgatttaaggaaccgatacatgagtggaaattctgtgtggcatttctgagcagaagttttatgaggcagcacatgctcactgtgttacctgttccttctgccatgagactggcagatggacattctctatcagccaggatatcagaatgaagaaatgtagaacatagaccaaaacaccaatgagaaataagcgtttgttgttttagggaaagtgtgttaccacagcataatttaacctatcccaagtgaatacatattcatggagttaatatctatacctgaaaattgaaactcaggttgtctacatctaactatgcctctgtcttttccaaaggtataaagtaggagaaacttccccatgatcctactcttccagtgttaactacagttaaaatttagtgtaaaatt

SEQ ID NO: 7479 - DNA, 316 bp, Homo sapiens
gacagaggggacagattcctcttagtcaagtcctgattaaaactccagctaagacattagtaagccttggttagtgaagtggcatcaggaagtgcctacattttcatggcctggtagcgttcagtgaaaatgttcattaacagacacaggccattcagtcccgaatcccaagacactgaagactctgtttgaatcagactcacgggttccttcctagccactctcagggacaggaatgcttctggtgaagaagttttcggtggtggttcatggagcttccctacaccaacttggaaatggcattcattttattggc

SEQ ID NO: 7480 - DNA, 267 bp, Homo sapiens
tacggctgcgagaagacgacagaagggtacggctgcgagaagacgacagaagggtacggctgcgagaagacgacagaagggtacgggtgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaatggtacggctgcgagaagacgacagaa

SEQ ID NO: 7481 - DNA, 624 bp, Homo sapiens
acagaagggaataaatcgagtcttttgttcagaaagcatttcccaaagcgacaggccattagatcatgtagcgcccaggaaatagatacttgcgttacaagctatgttgaagtcctgcacgccccggcttggatgtacaatgaggagtctgtgtgcccggctgcctggccagcccagcccgagcctcctaccttctgaaaatacacttgctggacatagcagagaaagctggtacatctccagcccttcagggcttcttgggacacactgttctggggaaaaccctttcatcaaaaggcatgtggggggctcacaaggaggtgaaggagtgaataggatgtgcctggcctttaatgacccaatcttagggtgaagagtggccctacagagttgtcactctgtaaaatgaatgcattgtgatctccagtcctgaaactgaaccctctggtctcaaaacacttccattccctgagtcctaatgacagtgctcagccagaggcagctctcttcatcttacaaagtagtaaagcacctgtctcaacagacagctataccccaagcctctcatggtcccttagcagtaaggctatggcctcatttttgtcccttctctggtgactcttc

SEQ ID NO: 7482 - DNA, 492 bp, Homo sapiens
gaaaaacccgggagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatg

SEQ ID NO: 7483 - DNA, 363 bp, Homo sapiens
agatcactcatttaagaggacttagagttgtgtgaagtaatgttgtccctaattaatatgtatataattttacattgagtttctggccaaaggacctaactcctattttttaatgtagagaaaaactcctttagaaaatatttcaatgggcgttagaattttgttttgttttttaagacagaatctcgctctgtcacccaggttggagtgcagtggtgcaatcttggctcactagaacctctgcctcccaggctcaagtgatcctctggcctcggcctcccaaatacctgggattacaggcgcccaccaccatgcctgtctaatttttttgtatttttggtagagacgggagtttcaccatgt

SEQ ID NO: 7484 - DNA, 411 bp, Homo sapiens
gtactagttttatagttcgaggtcttggctttacatctttaaacaactttgattttacttttgtatttggtgatagatactagtctgttttcattcttctgcatatggatatccagttttttcaataccatttcccaccagtgtatgttcttggcacctttgtcaaaaatgagttcactgtaggtacatttgtacgtttgttactgggttctctattctgttccattgatctatgggtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagt

SEQ ID NO: 7485 - DNA, 666 bp, Homo sapiens
acagaagggatccccaccttggctgtcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatcataatcctctct

SEQ ID NO: 7486 - DNA, 438 bp, Homo sapiens
gggagtttactgaagagtaggaaaggcttcccggagtaggagttactggaactagtgttgaatatatttaggaatgaaccaaaaaaagggtgcttgggtatggtggctcacacttgtaatcccagcatttggggaggctgagttgggaggatcacttgagccccaaagttctaaaccagcctggacaacaaagcgggactcctgtagctgtgtgtggtggctcacatctgtagtcctagctacttgggaggctgagatggaacaataattcgagcctgggtggtagaggctgcagtgagctatgatcgcaccactgcacaccagcctgggtgatggagcgaaaccctgtctcaaaaaaaagagaaggaaacaaagggtgtgggctgggcacagtggctcacacttgtaatcccagcactttgggaggctgtggtgggc

SEQ ID NO: 7487 - DNA, 469 bp, Homo sapiens
gtgattttataattaaaataatatctgctttttaaaatgagtggaatcacattctgtatttttttattctcttaaaattatttttcccttaagtgtttaaaagtcacctgtaaaactggctagatctggcaatttccccatgctaaaattttagattactaatttttttcactagttaataggtctgttacagatttctcatttttcttgaattaattttgatagctaatattttcatatgaatttctacattttatcttttttatttagaggcatacatttcttaatatattcttatctttttaatttgtttctactcatgtttctttatccctttttcataattatatagtttatttatgccttcttttttcctttatcattcctgccagacgtttgtcaattttattaatcttttcaaagaaataacttttgttggctgagcgcagtggctcacgcctgtaatccc

SEQ ID NO: 7488 - DNA, 549 bp, Homo sapiens
gtattttcaactttgaattgtaatcagaaagaaaatatattttaaccattgtttagtgcttctgttatatattgaaaacttcagtcttaattttttagttacattgttgatagggcattatataaatatacttctatagtcattgtaggaaatgtcttttataaggaaatatttcttctacctctgaattacacagttttgtatttacttggactgcatggcaacattcaaaaaacactttgaataacagataaaaatgacattttctaaagctctaggtttgctagatgcatgaagtctcagcaaagtataaatttgtaaatatttcattgtaaaatatcataaattgactccttcaagtgttcagtagtacaataggtaatcaataattggcctcttgggactgactgtaacgttttggtgtttgtatgttttgagacagagcaatagattgcctccatatcttttaaacattcaggtctcttgtataagaaaaataaccattgtggggggttttgtgcatcttatactaatatgaaacaaacaaaa

SEQ ID NO: 7489 - DNA, 424 bp, Homo sapiens
gacagaagggcaaaagcccttgcatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagc

SEQ ID NO: 7490 - DNA, 293 bp, Homo sapiens; identical to SEQ ID NO: 2288

SEQ ID NO: 7491 - DNA, 546 bp, Homo sapiens
gagtaaggaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaatattacaacttt

SEQ ID NO: 7492 - DNA, 540 bp, Homo sapiens
agccttctaaccctcaagtctttagaagctgggtggactcttagtggtcctgcagcgtatcctaaaagactacctttgaaacaggattcttgtatggccaggatcgtgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttg

SEQ ID NO: 7493 - DNA, 499 bp, Homo sapiens; identical to SEQ ID NO: 2290

SEQ ID NO: 7494 - DNA, 596 bp, Homo sapiens; identical to SEQ ID NO: 2291

SEQ ID NO: 7495 - DNA, 427 bp, Homo sapiens
gggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctggaagattgggcaagagaagaattcagaagaaacaaaagtgccaccgaagaggtgagaacaaaatcatggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaa

SEQ ID NO: 7496 - DNA, 441 bp, Homo sapiens
agaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttga

SEQ ID NO: 7497 - DNA, 467 bp, Homo sapiens
cctacatgatacagtggtgtcagccttgccttgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgttttttttttttaagtggctttgtttttttttctcaagtaaaa

SEQ ID NO: 7498 - DNA, 248 bp, Homo sapiens
gacagtagaaagtcagaaggtcacaaagcttgcagggtaagtgacacaacttgaaactgcttggccctctttaaaaagaaataataaaatgggagagaatgaagcaagtttacctaacacgtctttgcaaggtaaaaagatggcctatcagaaggtccatgcagatcaaagagctccaggacactcacagtacttagacaatgatgaccttcaagccactgcccttgacttagagtgggacatggaga

SEQ ID NO: 7499 - DNA, 594 bp, Homo sapiens
ctccagaagtttcccccttgggcggtggtggaagtggtaaccgtgatagtagcagctccggcggcagcaacagcgactacgagggatggcggcggctgcagcaggaactgcaacatcccataggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttc

SEQ ID NO: 7500 - DNA, 655 bp, Homo sapiens
acagagggggcgtgcgttggggcctcagcctttatctccactctgcggagattcacgcctggaaaacgctcttctgagaggatctgtggaggtcaacccaggagagagaagacaggactgaagcactgaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgagagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtcta

SEQ ID NO: 7501 - DNA, 619 bp, Homo sapiens
atcgctgagggcttggtcaaggccaccacagtgggccagatgggctggttcttcctcatggctgtgatgtacatcactggagctggcctttatgctgctcgaattcctgagcgcttctttcctggaaaatttgacatatggttccaatctcatcagattttccatgtcctgggggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactggacaataaactttccatttccattctcctagctggggatggggcatggtcaaacttagccatcccctcctcagcaaggcatctaccggcccctcacagagacattactttgaaactcatgttgagattttaccctctcctccaaccattttgggaaaattatggactgggactcttcagaaattctgtctt

SEQ ID NO: 7502 - DNA, 552 bp, Homo sapiens
gagggaggatttcgcaggaaaatggagaaagggttacacacaaaaaaggttaaactactctatgcatgtttctgcaatgtgttatctcaggaactcatttctgtagcccatcagggcaggagctgggctctcacctgttgataatattccataagggaggttcttccccacagtgtttagtctcccgacgctggtacagcctgacatgatgacattctactttcatgtcggtcatgctgcagggaaaattctgagtgttctaataggctggaatcatttgctagggtgaaccccatctttggttctcactttctgttatcttgtaattagctttattctcagcaaatccatgtctattttatttatctgtttatttacttatttttatgtatggaaaaacacttttttttatttacttatttatttagagacaggtctccgtctgttacccaagctggagtactgtggtagagtgctgtgatcatggctcattgcagcttcaaactcttgggctcaaatgattctctcacctcagcctcctgtgccaccatg

SEQ ID NO: 7503 - DNA, 580 bp, Homo sapiens
acagaaggggtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctc

SEQ ID NO: 7504 - DNA, 490 bp, Homo sapiens
tacggctgccgagaagacgacagaagggataataacgttaaaacttgtttagaaattaactagtattttttgaggtttaaagaaccttccagttttactatattagaaggcttcttttattgtatgcggtctaatttttattaaaagttcaggccatgaaaggttaagtatgtatcccttcaaaggaaattccattatcagagttagaattgaaagtaaaggctgggcacggtagctcacgcctgtaatcccaacactttgggaggccgagacaggcggatcacgaggtcaagagattgagaccatcctggccaagatggtgaaacctcacctctactaaaaatataaaaattagccaggcatggtggcgtgcacctgtagtcgcagttgccaggtaatttaagtgctgcttggtgaccagcttgtagacagtcactctatttatacccgcagactgaacaggtgcagccttttgccaagtctacccaac

SEQ ID NO: 7505 - DNA, 422 bp, Homo sapiens; identical to SEQ ID NO: 2292

SEQ ID NO: 7506 - DNA, 299 bp, Homo sapiens
gattggttaagcttaagtttccttttattatttacactgagtcaagttttggtttatttaaggaggaattgagtgcacggcagccacctcagcctcatggccacctgtttattggattattttaacagagaagatcctttaaaaaatatctgttaccctggctggagtgcagtgacgtgatcacggctcactgcagccacagccttccagctcaggtgatcctcccacctcagtgctccccaccctgagtagctgggactacaggcatgtgccaccacaccaccatgctaggctaatgg

SEQ ID NO: 7507 - DNA, 344 bp, Homo sapiens
tatatgagcagtagtcagcagcaatgacacggttcttaagtaataaaagagagaatctaggtctgggcatggtggctcatgcctgtaatcccagcactttgggaggccgacgtgggtggatcacctgaggtcaggagttcaagaccagcctggccaacatggcgaagccctgtctctactaaaaaatacaaaaattagctgggtgtggtggcgggtgcctgtaatcccagctagttggaaggctgcgacatgagaatcactggaacctgggaggtggaggttgcagtgagctgagactgtgccactgcactccagcctgggcaacagagcaagaccctgtctcg

SEQ ID NO: 7508 - DNA, 338 bp, Homo sapiens
atagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgag

SEQ ID NO: 7509 - DNA, 534 bp, Homo sapiens
gggtgtgtttggggaactaaaaagggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgtt

SEQ ID NO: 7510 - DNA, 210 bp, Homo sapiens
cagaagggtacggctgcgagaagacgacagaagggtacggctgcgagaagacgacagaagggtacggctgcgagaagacgacagaagggtactgctgcgagaagacgacagaagggtacggctgctagaagacgacagaagggtacggctgctagaagacgacataagggtacggctgcgagaagacgacagaagggtacggctgcgaga

SEQ ID NO: 7511 - DNA, 291 bp, Homo sapiens
gatccgggctttgaaaaccttaagcacttaaatgacaaaacagtcgcgcacacagagatagatgtaaaggtgatattttacttaacattttttttaacacccaaatttgctagtagagaaaaagagaagagggaagactcccaaatggttatgaagtttgggagaggagctttataggggtaacatgaagatgaggaacctaatatgggattagagcataggaaaagagacacagccttagattctattcaaaatagtcagtgtagaggccaggcacagtggcttatgcct

SEQ ID NO: 7512 - DNA, 511 bp, Homo sapiens
acagaagggatttctgtcactgccagatgtacaagatactgtaaaaggagcattttctctagcaaattagacttgctagctccatggatctagattgactaaaacagcttgttgccccagggatgtagctggatttggcttggtcatttcttttaaatataggacttcagaaacctgatctagagtccttttcttttggagacagtatcttgctctgttgcccaggctggggtctagtggcatgatcatggctcattgcagtctcaacctcccaggctcaagtgatcctcctgcctcactctccctagcagctgggactacagacgtgtatcaccatgactggctaatttttgtattttttatagagatgggctttgccatgttgctcaggctgttctcaaactcctagactcaagtgatccatctggctcagcactttgggaggccgaggagggtggatcacttgaggtcaggagttcaagaccagcctggccaacatggtgaaacgctg

SEQ ID NO: 7513 - DNA, 451 bp, Homo sapiens
gagttctcaaaattatcattagattttcgcagtggtctttgattcagatatgattaaaagaaccgcagctctgtttgagaatcagtgtggaccagtatgagagatactttgcttttatcctgttccttttcatccttccctcctcactctctctctctctttttctctcttcacaaacaagtatataacattactttaaaaaaaaaaagcaatgctttctggagtggggcacggtggctcatgcctgtaatcccagcactttgggaggtcgaggtgggtggatcacctgaggtcaggagtttgagaccaatttggccaacatggtgaaaccccatctctactaaaaataaaaaaattagccaggcgtggtggcaggagctgtaatacgagctacttgggaggctgaggtaggagaatcgcttgaacctggggggcagaggttgcagtgagc

SEQ ID NO: 7514 - DNA, 235 bp, Homo sapiens
ccttgttccgtgctattcctttaacttatgtgaagttactggatttctggttacacttaagcaaactgaatttcaattcctattttctctttagaaaattgatgtaatttaggccgggtgcagcggctcacgcctgtagtcccagcattttaggaggccgaggcaggcagatcacgaggtcagatcaacaccatcctggctaacatggtgaaaccccttctctactaaaaatacg

SEQ ID NO: 7515 - DNA, 89 bp, Homo sapiens
gacagaaggggaacatttattctgattctttatatcagggattcttaaggtactcagccttttaactggtctttctgtgatcactcttg

SEQ ID NO: 7516 - DNA, 278 bp, Homo sapiens
gaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgc

SEQ ID NO: 7517 - DNA, 478 bp, Homo sapiens
ggggaaaaaggggcggcggactcggcttgttgtgttgctgcctgagtgccggagacggtcctgctgctgccgcagtcctgccaactgtccgacaatgtcgtcccacctagtcgagccgccgccgcccctgcacaacaacaacaacaactgcgaggaaaatgagcagtctctggccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagag

SEQ ID NO: 7518 - DNA, 293 bp, Homo sapiens
tattacaaatggaattattaagtaaaaggtataagtgtttgtatggcttttactatacattaccaaaaaaatgtctaggctgtttttctgtttgtttgttttttgttttttgagacagcctcgctctgtcaccaggctggagtgcagaggcactatctcggctcactgcaacctctgcctcccaggttcaagagattctcctgcctcaacctcccaagtagctgggattgcgggtgcacaccaccacgcccagctaatttttttttttgtgtttttagtaaaaacggggtctc

SEQ ID NO: 7519 - DNA, 511 bp, Homo sapiens
gacagaaggggagatcagcctgaccaacatggtgaaaccctatctctactaaaatatagaattagccaggcatggtagcgcacgcctgtaatcccatcttcttgggaggctgaggcaggagaatcgctagaacctgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagattttttttgtttgttttcttttttctggttgttttttgttgttgttgtttttgttttacagctgaaaccaaccagcaagcccttgatga

SEQ ID NO: 7520 - DNA, 570 bp, Homo sapiens
ataaactctaattgcttcaacagagttttatggtaagaattgtttagtactaccatttcacagatgagaaaattgaggctttgaaagcctgaataatttgtgaaaagatacaaagctcctatgtggtcagactggaattttaatctacttgtacctgacattggatcctagactcttcaataggttacacttccttcgaactgggaaaaggtagcacaaatcatttatttttaaatcaccgatactagttttgttgtttaaggcatttaatctaagttgacttccccaaaggactgtgcagatgttttctcaaattaaagtgatatttcagaacaacaagtactagaaaatttaattcaactaaacagtaaattctagaaactgggggatcttttggcctctcatacaattttattcgtataactatgtgtcccggccagtcatgataacatatacttgttcaattgataaaaactgaactgaattcaagtcatagacttactgtagaggcttgggcacatttgcagaatatacacttggaatatgcaatgaggaatagaggttaagaag

SEQ ID NO: 7521 - DNA, 488 bp, Homo sapiens
gacagaagggaactgaagtgagccaaaggaaaatatgctggggcaaagtttagtgatccaccttctcctagtgttcttccaaagcctcctagtcactggatgggaagcactgttgaaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatggaaatttgccttgtcgcaacatacaattgcaaaagatgagtttaaaaaattacatacaaacagcttgtattatattttatgttttgtaaatactgtataccatgtattatgtgtatattgttcatacttgagaggtatattatagttttgttatgaaagtatgtattttgccctgcccacattgcaggtgttttgtatatatacaatggataaattttaagtgtgtgc

SEQ ID NO: 7522 - DNA, 488 bp, Homo sapiens
ggggcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagacagagtttcgctcttgtttcccaggccggagtgcaatggcgccatctcggctcaccg

SEQ ID NO: 7523 - DNA, 409 bp, Homo sapiens
gtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgc

SEQ ID NO: 7524 - DNA, 468 bp, Homo sapiens
gaggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaaca

SEQ ID NO: 7525 - DNA, 462 bp, Homo sapiens
gaaagaaatagtttgggacaaagaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatccc

SEQ ID NO: 7526 - DNA, 537 bp, Homo sapiens
ggaatcaatgtgcatgcgtgtaaatatatacacatatgtacatgtactatgtaaacatgttttggatttcttttagccaacaaatggaattttcttgagcatgtttctaatcgttttgccattggaatccatggctcatgggctcttccatgaattgggtaactgtttaggaggaacatctgttggatatgctattgtgattcccaccaacttctgcaggtacagtaatctagtatagttagtgataactattcacttcataacattttcttaatatttatatgaataaaatatagctccttttcaaaactgttttcaaaatataacttgtgcatttcttccaaatttttaacaaactttattccaagtgataatatcttcagagttaaattgaaatattttgataaatatgataagcttatattttagctagaaaccagaaaatattcatgaataacttttctaaggaaagatcttaccctaaagggaatattttgttaagaaagtgtcctctggctgggtcgtggtggctcacac

SEQ ID NO: 7527 - DNA, 530 bp, Homo sapiens; identical to SEQ ID NO: 2303
  misc_feature 478: n = A,T,C or G

SEQ ID NO: 7528 - DNA, 562 bp, Homo sapiens
gacagaggggtcctgccagcactttggatgatagagtttttgccaaagaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaggaagactgacaaacaacccctgcagaagccctcacattgcaccatctatgtggcaaagaactatccaccttggcaacataccaccctgtctgttctacgtaaacactttgaggccaataacggaaaactgcctgacaacaaagt

SEQ ID NO: 7529 - DNA, 586 bp, Homo sapiens
atctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacact

SEQ ID NO: 7530 - DNA, 545 bp, Homo sapiens
acagaaggggtttttgctgaaatgaacaccttaggatgctgaagaatatgacccgtcccatggaaaacattcaaaaatgtgtgtagcgctttcttcccaagggtgtgtgtgcgcatattttaacactaattcactttctacttccgttgctatcctttctgtgagtctttctcagaatctcagaaaagaaactaaattgttcactctagttatcaatgctgtactctatacctggaatttgctaaaagggcagattttaagtattctcaccacagaaaagagaaaagaaaatggtaattatgtgacgtggtggacatgttaactagctttattacggtgagcatttcacagcggatatccagtcatcacgctgtacacattaaacatgtacaattgggtttttttgagacaaggtctccttctgtcacccagtctggagtgcagtggctcagtcgtggctcattgcagcctcgacctcctgggctcaatccatccttccccctcagcctcctgaaaagctggggccacaggcatgtaccatcatg

SEQ ID NO: 7531 - DNA, 564 bp, Homo sapiens
gacagaaggggaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctc

SEQ ID NO: 7532 - DNA, 87 bp, Homo sapiens
gatataattgactatctgcttaatcagcttaagaacgccagcaatgatatcgttagacacggtggcagtctgggccttggtttggca

SEQ ID NO: 7533 - DNA, 595 bp, Homo sapiens
acagaggggagttttgcaatcaattcctgttcaaaggccaccctactcttcctatccgtctttctccagcccagacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctgatggacaaccaggcggagagagaaagtgaggctggtgttggtttgcaaagggatgaggatgacgctcctctgtgtgaagacgtggagctacaagacggagatctgtcccccgaagaaaaaatatttttgagagaatttcccagattgaaagaagatctgaaagggaacattgacaagctccgtgccctcgcagacgatattgacaaaacccacaagaaattcaccaaggctaacatggtggccacctctactgctgtcatctctggagtgatgagcctcctgggtttagcccttgccccagcaacaggaggaggaagcctgctgctctccaccgctggtcaaggtttggcaacagcagctg

SEQ ID NO: 7534 - DNA, 500 bp, Homo sapiens
acagaagggcacgtactcccaaatcatcatcatcattatcgtcatcattatcaccatctgataaaattaaggaaacagtaaatcatgagaaaaaaaaatgaaagaggagattcagaaagttgtggagatgaatcaaaagtacaaaatacagaaaccctgggaatcaagattttaaaaatgctataatcagtggccaggcatggtggctcacgcctgtaatcccagcactttgagagacagaggcaggcggatcacctgaggtctcctgacctcagagaccagcctggccaacatggtgaggcccggcctctactaaaaatacaaaaattagttggacgcaatggcacacgcctgtaatcccagctactctggagactgaggctggagaatcacttgaacccgggagagggaggttgcagtggcgcggtctcggctcaccacaggctccgtctcccgggttcacgccattctcctgtctcagcctcccgagtagctgggac

SEQ ID NO: 7535 - DNA, 501 bp, Homo sapiens
ggattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggttcagcctgtaataccagcctccactttgggagtctgaggtgggagtattgcttgagctcaagagttggagaacagcctgggcaacatggtgagacctggtctttacaaaaattttttttggccggacgcagtggctcacacctgtaatcccagcactttggg

SEQ ID NO: 7536 - DNA, 534 bp, Homo sapiens
  misc_feature 42: n = A,T,C or G
ttaaaatttaatagttccgtactcatgtgaatgtatgttagngaaaaatataacaagcacattgtcgatttcgtgagtattattgcttaagatcgggttaagtaataagtaaaccaattgaatattttatttcagttgaaaagaaaaatactgaagaattttaatgcctttaatggggtacttgagtatggcaaaaatcgggaaggctgagagtgtcatttgggagctgtgtcccaagtccctcgtgggcctttaatcagcagttacagatctgcagctcctcctgtaggatggaagcactttgctctttggccttttgaggtcacccagctatttgaaggtcaggggcaactcgattctaatgagatcaaggtcacagggtcatgttgcccccaggaaagtgggagatggagttctgtggtccaggctgtggccctgctgcagggctgggaggtggagaggtgtggacagagaaggacctcccatcctcaccggcagagaaagctcagagatgctcccagctggtgatgaggc

SEQ ID NO: 7537 - DNA, 424 bp, Homo sapiens; identical to SEQ ID NO: 2314

SEQ ID NO: 7538 - DNA, 535 bp, Homo sapiens
acagaaggggatatttgtggtaaatccactcaggcagagtgacagaggcttggttgtcatttagcctttagggtcttagtggagttaatgagaactgcaaatggtcatcaagtcttggtgcttcatggagaagcaacacttttacagtgagtgtgttagcttagtggttatggtattactgcagggacatggatcacttagggagagagcgtttcaggcttgggtcagtcttaaagcagatctcatgtggagggtttctgctaacctgcatctcttacaacacagtactagtcagtatgctgtagtattaatcagtaggtcaagttcagtgaagtaaaggagaattgaattcttgaagttcacatttaggcaaaaatttggcgttttaggaggtgagtataagacatgatctttatagaaaacgctgatgataaaaacagcgctctctgttaggtgcctttatgcttgactccattgtcatcttttcttaagaaactaagctcaggactgggtgcaatggctcatgtctgtaatc

SEQ ID NO: 7539 - DNA, 488 bp, Homo sapiens
gacagaaggggaaatgctttcggtaggcactccacggctgtgaagatggcggctgctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctctttt

SEQ ID NO: 7540 - DNA, 453 bp, Homo sapiens
acgacagaagggggggtttctccatgttggtcaggctggtcttgaactcccaacctcaggtgatcctcccaccttggcctcccaaagtgctgggattacagtcagtgacccactgtgcccggcctgtatttgtatttttagtagagacagggttttaccatgttggccaggctggtctccaactcctgacctcaggtggtccgcccacctcggcccccagtgtgctaggattgcaggcgtgagctacggtgcctggccagttaatcagttttttaccctcctgtgtttaggccccaacatcctgttcttgatcttttttggcaaaaatttggccaaagattgaaattttgcctcctggaccatatattttgctccagttgcaaagtatgacttttatcctttggtcagcagttcccatggtgtttagggcctgaatttgacattctttttttt

SEQ ID NO: 7541 - DNA, 405 bp, Homo sapiens
  misc_feature 154: n = A,T,C or G
caggcttcctaactgtcatggacaccaggcaggcaggtaggggaatgaagcaagatttggcagcgcagctgctgtgagtttgctctccagtggcttggaaatgggaagtaaaggatactgatcttatgtgagaggcgggggcagactgtcctantctgccctcacatatccctggaatgggcacatacaggctggtcagggctttcttggggcactgaggtgggagaagctggtggcctgggcagggtagtggaactgagagtgagaagccccctacacttggatctcttggggggacacgagactcatttatttattctgcctagctggctcataatactgatggctgaatgggggtatgaaaactggtcctcaagagtatccagtcttattgggggaataatg

SEQ ID NO: 7542 - DNA, 60 bp, Homo sapiens
gggagatgggggccggagatggacttgccatgacaggtgcagttcaggagcagatgagat

SEQ ID NO: 7543 - DNA, 56 bp, Homo sapiens
gaaggatggaataacccaaggaaaacgcacgtatggcctgctacttcctatgggct

SEQ ID NO: 7544 - DNA, 590 bp, Homo sapiens
  misc_feature 371: n = A,T,C or G
gcatatacggtcaatgccatagtaagtaacactgtattatgttatactaaaatattaataaatctaggttggttcagtctttcctgagtccacagattggaagcagattgaggaaggacgctagtggaccacagagctgaaccatgcacacagaagaaatctttttttctttttttctggagacggagttttgctctctagttgcccaggctggagtgcaatggcgcgatctcggctcactgcaacctccacctcccaggttcaagcgattctcctgcctcagcctcccgaggagctgggattacaggcgtgagccaccctgcctggccacttttgtatttttagtaaagacagggtttgaacactgggcncaaggcctggtctcaaattcctgacctcaggtgatccacccacctctgcctcccaaagtgctgggattacaggcatgagccaccgcgcctggccagaagaaatctttatcttggtgtgcagtgtctggtgagggacaaatgtcatctctcttggatctgaatctgaaaggatcaaggcactgaagggatttttttgtttcagacagtatccctctgtcg

SEQ ID NO: 7545 - DNA, 407 bp, Homo sapiens
cacgcataggcttgtattcaggaacaattttacaaactccagaaaaggcagcaggagatccagaatctctgtgtgccttctcttcatcctacccccagaaaaatggccagtccagcccagcacctgctgcagcctcaatattaagggactgcttgtcccatctcttgcccaggggaagtcggagagaaagctcgcccgtgtgcatgtttgatataggctgtgtgtgtaggcagggagtgggctagaggaccctggacaccttggccagcctcctaggcagtgagttagaggaaaggggactaggtcttgcacctctgccatacctcgggatccagacagaccaggcagcgtgttaatattggtgttctgcatggtggacccaagctaaagtgttgcctgcagccaag

SEQ ID NO: 7546 - DNA, 664 bp, Homo sapiens
aaccctcactaaagggaataagcttgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccacccctcgtgccgaattcttggcctcgagggccaaattccctatagtgagtcgtattaaattcgtaatcatgtcatagctgtttcctgtgtgaaattgttatccgctcacaattccacacaacatacgag

SEQ ID NO: 7547 - DNA, 719 bp, Homo sapiens
  misc_feature 172: n = A,T,C or G
gatgctggtctcgctgaggtgaacgctattcagcccaatagggggttaccattattgagtaaaatacttcagattgacggctcaatcttagtttgcctccagttaatcttttgtgcttagggattaagtgtgtggttttttttttgtttttttttttggagacggatctgcntcgtgtcacccaggctggagtgcagtggcgcgatctcggctcactgcaacctctgcctcctgggttcaaacgattctcctgcctcagcctcccaagtagctgggattataggcgccaccaccatgcctggctgattttttatttttagtagagatggggtttaccgtgttggccaggctggtctcgagctcctgacctcgtgatctaccacctcggcctccccaagtgctgggattacaggcgtgactagcatgcctggccatggattaaaatattcaaacatgttgtgtgtacccagatatgctgttaatttaggaaaacagtacaatttctatgaagtggttgtgactaatttctgtagtcaatacaggttgggatatctgatctagttctctgtctactttggagatgattgcataataaatagaagtgtaccctgttttttaaaaagaaataagaatagattagaaaaaaaaacggcggcagcagcgtattccattaggtagggttagtttaggctgacactgcgttcgtttagcacgtcgta

SEQ ID NO: 7548 - DNA, 410 bp, Homo sapiens
cggcacgaggcctcgtgccgggctctaatctctatttgagtgaggttgaggaggatttgacacaggaagtgaaagctcctatcatgtccccgattaccaggcccctgcctgtctctcctatctcagctctcatagcaatactagatcagattttaaattttgactcatgcccaattatttagacttcccaggtgcatcgtgtaatttctaccttagattatctagtcacatctatgctgagatcactttcccatttcataactaaaaactcttattgaacatttagactgtttctgtgactaacactctctaaagtcttttctgatgttccagggaataactgatgatgctgaatctgtattcatttttaccctgtcttgaattatatcattaacattctgataccctat

SEQ ID NO: 7549 - DNA, 172 bp, Homo sapiens
gaagctaattatgattttatattttagaatcattgggtatctaccccatgcaggcttagttgaagtgatagccttttggcttttctgtgtatgatttgtttttatgtaaattatgtagactagataaatgtttatttatttttaaatgtcagttcatagggagtttctgata

SEQ ID NO: 7550 - DNA, 600 bp, Homo sapiens
tcggcacgaggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgccc

SEQ ID NO: 7551 - DNA, 677 bp, Homo sapiens
tcggcacgaggcgtcttcactgctctgtgtcctctgctcctagaggcccagcctctggtcctgtgacctgcaggtattgggaatccacagctaagacgccgggacaccctggaagcctagaaatggacaacctgaggtatggagtgtatcctgtcaagggggcaagtggataccctggggctgagaggaatcttctggagtactcttattttgaaaagacggagtttcgctcttgttgcccaggctggagtgcaatggcgcgatctcagctcacctcaacctccgcctcccgggttcaagcgattctcctgcctcagcctcccgagtagctgggattacaggcatgcaccaccaccctggctaattttgtatttttagtagagacggggtttctccatgttggtcaggctggtcttgaactcccgacctcaggtgacctacctacctcgacctcccaaaatgctgggattacaggcatgagccaccgtgccaggctgggatttaagtttttcttaggtaaacttaggaaaaacagaactggaaatactccagtgacatagaaaacaaattctacctaggttcttttccctgccccagttctgatcagattcaccatttttggaggccttatttaggtctggcctcactctggagtgttcccttacaaactgatttat

SEQ ID NO: 7552 - DNA, 483 bp, Homo sapiens
ggggaacggcgccgagtcagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatg

SEQ ID NO: 7553 - DNA, 582 bp, Homo sapiens
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatg

SEQ ID NO: 7554 - DNA, 183 bp, Homo sapiens
gatttatcttcactctgatgagggctcagacttgataacacccgtggtgccccatccctataggagctggtgagattgcagcctgctgcctcccctccatcagccacagctattggatttcccacccagaatctttaggtaaatgaggtaagtcctgatttttaaaacttcttttgaatctgg

SEQ ID NO: 7555 - DNA, 140 bp, Homo sapiens
aattcaagaaataacccagagactcttcttcttgcaagttaaagaagccatcttaaatgatgagatatattgcccgccagaaactgcagttcttttggcttcctatgctgtccaagccaagtatggagattacaataaag

SEQ ID NO: 7556 - DNA, 549 bp, Homo sapiens
gatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggggttatgggatgtgggcatccctgggttcttggaagcagctcttatgctactcatagagatgggattgactttatttttttatagtgcttaattcaccattatgagaaatgctcccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccct

SEQ ID NO: 7557 - DNA, 71 bp, Homo sapiens
gacagaaggggaaacaatttggagaagatagaagtttgaagtggaaaactggaagacagaagtacgggaag

SEQ ID NO: 7558 - DNA, 517 bp, Homo sapiens
gaatttcgagaaaattaagcgccaccctgggagttgatttccaaatgaaaaccctcattgtggatggagaacgaacagttctgcagctctgggatacagctggtcaggagagattcagaagtattgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattg

SEQ ID NO: 7559 - DNA, 566 bp, Homo sapiens
gactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcgttaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaa

SEQ ID NO: 7560 - DNA, 567 bp, Homo sapiens
tttggccgagcggcctaggctgcgagagacacagaggctccttaaaagggctgactgcacttgaggcacccttttctattcctgcatgataacaagctctaacagccatgaccgtagtgtagccttgaaatcacaggctgtggataacaaagcagaaagagagcagcagtctgggtctctcatcttcatggacttgtctcatcatccctaagctgcttaatcagatttcctataattgacaggataaattttgggtatttaaggcattgtgttttagatctcttgttactcatttcgaactcaatccctcattaaaacttaactgctcgtattttattttatctgaggcgttcttcagtatatagctggtatgattgctctgtggaaatgtagtgaatctgtgccgttctacttttacagggtattttacaacactactactttatgtaaaaagttctctaataggcactcatttcattaattctcacaggcattatgatatctattttagagatgaacaaacttattctgcataggattaatgacagtattatgttcagtaacagc

SEQ ID NO: 7561 - DNA, 433 bp, Homo sapiens
  misc_feature 288: n = A,T,C or G
cgtgggttacatcaatgatgcctttacagtgctactccgaagcttttaagctggatccccacaaccacgtgctgtacagcaaccgttctgctgcctatgccaagaaaggagacgaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtntacagaatatggaggccaggttggcagagagaaaattcatgaaccctttcaacatgcctaatctgtatcagaagttggagagtgatcccaggacaaggacactactcagtgatcctacctaccgggagctgatagagcagctacg

SEQ ID NO: 7562 - DNA, 257 bp, Homo sapiens
gagattcgcgcagaccaggaagcggatagcgtggagtgacggtgccaccgcggcgcatggagtttcgctcttgttgctcaggctggagtgcaatggtgtgatctcggctcactgcaacctccgcctcccgggttcaagcgattctcctgcctcagcctctcgagtagctgagattacaggcatgatccgttgctcccagccacccatgtattcctgattgaaaaaatttgcttatgtcttagttctacagctgaccc

SEQ ID NO: 7563 - DNA, 458 bp, Homo sapiens
acagaagggagtagacaaggcaggaaggagtagtgatgttcctgagttcttgctgaattctgacagcgtgccaacactttgatttctctgtcaaaatgggtgggatttgatatctaaaaaagtataccattacatatctaaaagtatattgttacatggaatatggaagccactgatttaattctggaatgtccgtcaacatgacagccacctaaactcctctgaggcattgtaaacggttaggaaaattgacctttctacacactaaatctggcttcagtggctctcctgagctctaagggagttgggcaggggcagcctgagctccggctgtgagcatagctcaactgatgtgtagttagaatgttcatggaaggcccaggcttgctacttcccattcctttattttaaatgatgtagtgagccaggcgtggtggctcatgcctgtaatccccgca

SEQ ID NO: 7564 - DNA, 581 bp, Homo sapiens
acagaagggctttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtact

SEQ ID NO: 7565 - DNA, 180 bp, Homo sapiens
gtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaaca

SEQ ID NO: 7566 - DNA, 353 bp, Homo sapiens
attgaaatattttgctatttcttctgcataagtgacagtgaaccaattcatcatgagtaagctcccttctgtcattttcattgatttaatttgtgtgtcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggt

SEQ ID NO: 7567 - DNA, 554 bp, Homo sapiens
ggccattttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccaaactcccgtgtattcattgggaatctcaacactcttgtggtcaagaaatctgatgtggaggcaatcttttcgaagtatggcaaaattgtggtctgctctgttcataagggctttgccttcgttcagtatgttaatgagagaaatgcccgggctgctgtagcaggagaggatggcagaatgattgctggccaggttttaaatattaacctggctgcagagccaaaagtgaaccgaggaaaagcaggtgtgaaacgatctgcagcggagatgtacggctcctcttttgacttggactatgactttcaacgggactattatgat

SEQ ID NO: 7568 - DNA, 571 bp, Homo sapiens
ctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacatgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaaggcatcttcgaatccatatttcaagcctggtagaattggcttttctagcagaacctttccaaaagttttatattgagattcataacaacaccaagaattgat

SEQ ID NO: 7569 - DNA, 263 bp, Homo sapiens
ctttctaggtttgatgaattttaaagtatctattttatgacagtaaagaagtacattaactaggtctctgtgctctagaattcaccaatgtgtaaagcattggttttcaggaaaggtaaatcaaagtacatgacaataacaaacatttgtatttttttttttttttaaagggagtttcacttttggtgcccaggctaaagggcaggggggccattttggctcactgaaacctccgcctcttgggttaaagggattctcctgcc

SEQ ID NO: 7570 - DNA, 529 bp, Homo sapiens
gcactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctatcgtggctgccatcaatggatcctgcctgggaggaggacttgaggttgccatttcatgccaatacagaatagcaacaaaagacagaaaaacagta

SEQ ID NO: 7571 - DNA, 62 bp, Homo sapiens
gctgcgagaatacgacagaagggtacggctgcgagaatacgacagaagggtacggctgcgag

SEQ ID NO: 7572 - DNA, 309 bp, Homo sapiens
gctggcccagcatgctgtttcagacagctttttctccatttccactctcacttcacagtgcagtttagattgctacccagtacttcccaaagcaagtgtgtttttcttttcttataccttttggccattattctacatcctgaagcattgtctttctttattattttatttatttatttttgccagacaagatcttgctctttggcagaaaaaaaatgataacaaataaattaggggtttaaattagtataataacatctgctgaggaataaatgaataaaaataataattaaaacaagacagtgcttc

SEQ ID NO: 7573 - DNA, 484 bp, Homo sapiens
gttttgcagacgccaccgccgaggaaaaccgtgtgctattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtc

SEQ ID NO: 7574 - DNA, 175 bp, Homo sapiens
aagggtacggctgctagaagacgacagaagggtacggctgcgagaagacgacagaagggtacggctgcgagaagacgacagaagggtacggctgcgagaagacgacagaagggtacggctgcgagaagacgacagaagggtacggctgctagaagacgacagaagggtacggctg

SEQ ID NO: 7575 - DNA, 481 bp, Homo sapiens
agtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctg

SEQ ID NO: 7576 - DNA, 209 bp, Homo sapiens
acagaaggtatcttgttgcaagtccaaatcaggggagactttgttaatatgtatcttttgctcaaatttagtagggtttttttttttttggaataaaggcctttcaaatttggaatttttaaaaacccattaaaaaaaatcccttcctaaaaaccaaattgaacacagtggccccccttgttaccaaccccaaattcccaattcccccc

SEQ ID NO: 7577 - DNA, 389 bp, Homo sapiens
atgaacctcaaccccatgatcctgaccaacatcctgtcgtcgccttacttcaaagtacagctctacgagctcaagacctaccacgaggtggtggacgagatctactttaaggtcacgcacgtagaaccatgggagaaaggaagcatgaaaacagcgggccagacagggatgtgcggaggggttcgaggtgttggaacaggaggaattgtttctacagcattatgcctgttatacaaattatttaccctgaagttaactcgaaagcaagtgatgggtcttataacacacacagactctccatatattatagcgcttggatttatgtatataagatatacacagccccctacagatctgtgggactggattgaatccttccttgatgatga

SEQ ID NO: 7578 - DNA, 559 bp, Homo sapiens
gatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaatttctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcg

SEQ ID NO: 7579 - DNA, 441 bp, Homo sapiens
gctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccatatgctaatttgcacgttgattcaccttctttg

SEQ ID NO: 7580 - DNA, 684 bp, Homo sapiens
gacagaaggggccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaggccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacacagcatcatcta

SEQ ID NO: 7581 - DNA, 536 bp, Homo sapiens
acagaagggatctttaaacaactttgattttacttttgtatttggtgatagatactagtctgttttcattcttctgcatatggatatccagttttttcaataccatttcccaccagtgtatgttcttggcacctttgtcaaaaatgagttcactgtaggtacatttgtacatttgttactgggttctctattctgttccattgatctatgggtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagttttacaatgctatcctcttttacaaagctatgatcaactcagtgtgtccagatcaggatcatttgtagctatttgcaaaagtagcaatattctggctgggcatggtggctcatgcttatattcccagcactttgggaggccaagacaggc

SEQ ID NO: 7582 - DNA, 568 bp, Homo sapiens
agtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacaggtatgggacgggaaagccagaggtaggaaggctcagaaggagacagatggctctaaaagagttttccagtgtgtattctgaggaatactagtgttctggagatgttacttagtgtttca

SEQ ID NO: 7583 - DNA, 508 bp, Homo sapiens
tttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttccaaagagaaatgtgcaatcacaatagcatgacatgggtacaaatatagaaagtatgtattaaagtattg

SEQ ID NO: 7584 - DNA, 443 bp, Homo sapiens
acagaggggctccttgaaagggctgagtccctcttgctcacccttgacttggaaaaaccagtttctcttttattgtctgttactaatctctattctaaaaattcagctcagttctcaaccatactccaaactctctcttttccagctacctttactccctctccttcaattccactttcctctgcttacttttttttttttctgacagggtctcactttgtcgcccaggcaggagggcaggggctcaatcttgggctcactgcagcctcaacctcccaggttcaagcgattctcctgcctcagcccctcaagtagctgggactacaagcgcacaccaccacgcctgactaatttttgggatttttttgaaaaggcggggtttcaccatgttgcccagactggtcttgaactcctgagcttaaccaatccacctgcctcggcct

SEQ ID NO: 7585 - DNA, 620 bp, Homo sapiens
agctaagacatactgtcagtctcacttctgctgtcccagtcctagaaatcctgggtagaagtggtggacctgtgcaaaggaggttttagaactctgcagtatttgttggggcatggcacaaataagctcatccctcccgtccgaggctagtttcctctggaaccacatttttatctagatgaaaatttggaatgaaatgaaggaatagaaatccaataaaagagttgaagggaaagaaaatttaaggttcttcttgctcaggattacagatatggaccaacacctccttcaagaaaaggtggtaggacacaaagttcttcagtcctgagccctacatgtggggctggaggagaactataacggaaaaacctctgagtttcaccttaggtatagataaaagaaagatggtccccttttatctgattctgagacaggtaaattctgtttgttactacgtttaattagaaggtggaggagtcatttcatgattaagaacattcaacatgtattgttcattaagctagcttcctagttccgattagactaaggagactaagcctagagagtcaatgtcagaacagtgaaaagaattctgtgtgtgtgtgtgtgtgtgtgtgtgt

SEQ ID NO: 7586 - DNA, 480 bp, Homo sapiens
acagaagggaggtttctgcaatgttttttgtaaatggccatttcattaggcatgaatggaagggctttattctgactgaactattattttaatgtcttattagaactagattatatactttgattttctaatatattttaagctttttaaaaattgtgatctctacaacaagaaatacattttacaccataagtcagtatacacatgaagattcatgcatgtggatttgtatatatgtaaaagtatagaaaatacattattgaaacaaaagtttcacaaaataatatttgcacttactttgcacaacaccctctaatattttctcttctagtttagtttttaaaatgctggttgagggcagggtacggtggcctctgcctgtaatcccagccctttggaaggctgaggtaggagaattgcttgagcccaggagttcaagaccaacctgggcaacatagcaagaccccatctcctaaaatt

SEQ ID NO: 7587 - DNA, 395 bp, Homo sapiens
tacggctgcgagaagacgacagaagggtacggctgcgagaagacgacagaagggtacggctgcgagaagacgacagaagggtacggctgcgagaaaacgacagaagggtacggctgcgagaagacgacagaagggtacggctgcgagaagacgacagaagggtacggctgcgagaagacgacagaagggtacggctgcgagaagaaacagaagggtacggctgcgagaagacgacagaaggggaacgtggtggtggtgggcacttgtggttcccagctacctgggaggctgaggttggaggatcgcttaagcccaggaggtcaaggctgcagtgagctatgatcgcaccactgcactccagcctggacaacagagcaagaccctgtctgaaaaaa

SEQ ID NO: 7588 - DNA, 154 bp, Homo sapiens
ggttgcaatctgtggatcaactacgagactgagagaaaggaatgaaaggatggaagaattacaagatcaggcactgatgtctgtctgttccactgatgtaaccacagcacacgcgtggctcacggtactagtgtgataaatgcttgttacatga

SEQ ID NO: 7589 - DNA, 587 bp, Homo sapiens
gccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcacttagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctacta

SEQ ID NO: 7590 - DNA, 211 bp, Homo sapiens
gtataagatatagtcttttgattatctactctgaaaaaatgggtttgggctgggcgcagtggctcaggcctgtaatcccagcactttgggaggcaaaggcaggcagattgcctgaggtcaggagttcaagactagcttggccaacatggtgaaaccccatctctactaaaaattcaaaaattagccgggcgtggtgacaggtgcctgtggc

SEQ ID NO: 7591 - DNA, 460 bp, Homo sapiens; identical to SEQ ID NO: 2338

SEQ ID NO: 7592 - DNA, 543 bp, Homo sapiens
gacagaggggcctggatttactgattgctctatcaataatgtgaccagtggaatcattcatcatcatagtgatcctctccatcatttttgaagagtatttttcctcagtttgtgcatgatttatttaacccttttcaaaatgtttttgttagccaggcatggtggcatgtgcctgtaatcccaggtacttgggattctgaggcaggagaatcatttgaacctgggaggtggaggctgcagtggaggctgcaccaatggaggctgcactgctgcactcccgcctgggcaacagagcgagactccatctcaaaaaaaaaataaaaataaaaaaataaagtttttgagatgaggtaggtttcattgttttaggattacaaagaatgctgcagccacctttcttgtacacatatctggtcattgtggaaatgtctacaccgcagatatttctatagtgtagggaagttgatgcactattgctacattataggctttacatgatgcttctaatttgagtacattctgcaaatgtatctttcacgggag

SEQ ID NO: 7593 - DNA, 331 bp, Homo sapiens
gggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggagattgtgccattgcactccagcctgggtgacaagagcgagacttcatctccaaaaaaaaaaaaaccacccaggcttgggggct

SEQ ID NO: 7594 - DNA, 173 bp, Homo sapiens
tactgatttgtaaaattgtataaaaaatattaactttcaggctgggcgcagtggctcatgcctgtaatcccagcactttgggaggccaaggtgggtggatcatgaggtcaggagtttgagaccagcctggccagcatggtgaaaccccgtctctactaaaaatacaaaaaatt

SEQ ID NO: 7595 - DNA, 400 bp, Homo sapiens
aggttaagccaaaataatgtggagtaattataacagatttccctcacagcttattaaataatactaaatatgtattgctggcactgcctctcccacatcatatggagacatttgtaggaacataatagcaggttacacagtaatctgttcttgagctgctgtagtagatattcagtgtgtatgaggaggaaaggtgctagtgagagggcagaatgggaaaaacaatttattttttttgagacagagtcttgctctgtcgcccaggctggagtgcagtatgcagtctcggctcactgcaagctctgccttctgggttcacgccattctcctgcctcagcctccgcagtagctgggactatgggcacctgccaccatgcctggataatttttgtatttttag

SEQ ID NO: 7596 - DNA, 583 bp, Homo sapiens
gatttgcttaactgatgtacttgatgatactataaaacctatattatgagaaagcattgctccttcaaaggaatcaagtgatagcaaacactcggtcctgtttccaggttttcctcactgttcattttgcctttgttcttgcaggcggagaataaaaggggcgagagctaaagtgtgttgtcaatgcaagtcaatcattaaccaacaataatttacaaaagaactttatatttgctgtaatcattaaatttagttactaatcccaggaaaagggttagtccttcctcctagtttgtagatttgcaaatggagatgaataattgaatcctattttaatcttttatctgcagtaatctgggcttcttattaccggatatatttgcattttacctccaggccatgttagttcttagaagattattttcctcatgaaccctgttttgttttgcttcctttctgcttcaattctaatgtcacattgcatacctggatgtaaacagcagtcagtttctcagatcaaatagagccctgtagcaacttggaagacacagaagacacacggacataaaactgtatttattat

SEQ ID NO: 7597 - DNA, 255 bp, Homo sapiens
gccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattattt

SEQ ID NO: 7598 - DNA, 628 bp, Homo sapiens
acagaaggggtaagtggagctgttaaaaacagcagtgctgtattgtagttatgtatattcgtgtacagtatgtttagatcccaggtaaacatattcttttctgagaggataaatacctgcatcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctc

SEQ ID NO: 7599 - DNA, 94 bp, Homo sapiens
gaagctcgagaagatggatagaagtgggaaatggagctagcgtacgggagaaggaaatggctggaatattcgtcaatctgtggtgctttactgg

SEQ ID NO: 7600 - DNA, 93 bp, Homo sapiens; identical to SEQ ID NO: 2342

SEQ ID NO: 7601 - DNA, 682 bp, Homo sapiens
gacagagggggtagaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacgggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattct

SEQ ID NO: 7602 - DNA, 480 bp, Homo sapiens
atataaacaaaaggctggagtcctgaaaatgctttatgtgtttgcaggggatatagtttatgaaggaggggattaggcttaaaaagagctagacagtgaaaggtgaaagtagggaacagtggaaggtgatatggcctttaaactttgctgcttacaggtctttcaggttacagtttgaacttgatcctggaagcagcagagaaatcaatcactggctactcttaaaacagctgagtgacacaatcaaatgtgtacttcagaaattttccatgtggcaatgtggaggatgggctggattgccttgttattgggagacaaattagaaggctactgcaatagtcctagcaagagatgatgacaggctgggcacggtggctgacacctgtaatcccagcactttgggaagctaaggtgggtagattgcttgaggccaggagttcgagaccagcctggccaacatggtgaaaccctgtctctacc

SEQ ID NO: 7603 - DNA, 425 bp, Homo sapiens
gttttttatcctgtagggcaggagtggttgtagatgccctctcatgtgctgacatactgattgatggtggcttttaaggtctctcctgagtctagtaggaggcaggcttcctaactgtcatggacaccaggcaggcaggtaggggaatgaagcaagatttggcagcgcagctgctgtgagtttgctctccagtggcttggaaatgggaagtaaaggattctgatcttatgtgagaccattttcagactgtcctagtctgccctcacatatccctggaatggacacatacaggctggtcagggctttcttggggcactgaggtgggagaagctggaggcctgggcagggtagtggaactgagagtgagaagccccctacacttggatctcttgcgtatcacacgagactcatttattgatgactgc

SEQ ID NO: 7604 - DNA, 135 bp, Homo sapiens
gtcaggcacagcccatgtatccaggtgcatcaaactggggatgctaagttcaaaagtgcgtctgttttgaagatttcatctgaaaataatgtgtacactttcattactaccagtttgcattcaaaatagtttttg

SEQ ID NO: 7605 - DNA, 508 bp, Homo sapiens
acagaagggattgatctgttaggactgcttaagagctaacttgtcacctgtgaaatggttggcttgatattttgatatttaaaggtttgccttttgcttctcgtgggtacaagccagagagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagcatttatgcacaggagcataaatatatgattttcatcttgccattgaaagtagactttccggccgggcgtggtggctcatgcctgtaatcctagcactttggga

SEQ ID NO: 7606 - DNA, 438 bp, Homo sapiens
gagaaaagaaagggaagaactgccttcttatactacagaacatgcattagtgtgggctatatagctgtggctcatgctacccaattccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaac

SEQ ID NO: 7607 - DNA, 505 bp, Homo sapiens
acagaagggaacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagatta

SEQ ID NO: 7608 - DNA, 592 bp, Homo sapiens
gaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctgtagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacacctattctcccaaagtaccttgaactcttagtgattgagactc

SEQ ID NO: 7609 - DNA, 90 bp, Homo sapiens; identical to SEQ ID NO: 6926

SEQ ID NO: 7610 - DNA, 124 bp, Homo sapiens
tacggctgcgagaagacgacagaagggtacggctgcgagaagacgacagaagggtacggctgcgagaagacgacagaagggtacggctgcgagaagacgacagaagggtaccgctgcgagaaga

SEQ ID NO: 7611 - DNA, 96 bp, Homo sapiens
tctcaaactcctggcctcatgtctgcctgccttggcctcccaaagtgctgaaattacaggtgtgagccactgtgcccggccaacatttcttaacct

SEQ ID NO: 7612 - DNA, 493 bp, Homo sapiens
acagaagggatctgtaggcacagtgttgtacagcagatctctagaacttaattcatcttgcataactaaaattatatgcatttaaaatagttaaactcataaaaacaaatattagaatggtggtttccaaggacttagggaagaggaactggggagttgctaatcaacgagtagtcagttggggtctacggtgaataaaagttgtcaattactatgcccaagtatagatttttggattagggatattcaactggtaagtttaattcaaatattccaaaatcccccaaattcaaaattcaaaacacatttggtcctaagcattttggataagggatactcaacctatatatggttgtacttgaagtagcgaaggaagggagagtaaatttggtgatttagtcctaccatgaaatagcagttacctttctggttctgaggtttctctgccaatacctacaccactgcctccaccaccaaaatggaaaaaaaaaag

SEQ ID NO: 7613 - DNA, 678 bp, Homo sapiens; identical to SEQ ID NO: 2354

SEQ ID NO: 7614 - DNA, 485 bp, Homo sapiens
gagatttttgcggctattttcgttggtgtgttggtcatgtctggtcgcggcaaaggcggaaagggactgggtaaaggaggtgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctctttataagttaattgttcctgtc

SEQ ID NO: 7615 - DNA, 569 bp, Homo sapiens
gacagagggggtttgtctcttcctgagaaacgagcaaacctgaaagctactctctcagcttcagaagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttgggcttctgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggc

SEQ ID NO: 7616 - DNA, 568 bp, Homo sapiens
gaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaacttcctcatggattctga

SEQ ID NO: 7617 - DNA, 550 bp, Homo sapiens
ctttttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatccgctggatttccaggggaagcaacagaacaagcatgtgttcttttttgacaccaaaaaggaagttgaacagtttgatgtcgcaactcacctgcaaacagccccggagctagtcgacagagtctttataggcccaggatagagaccttgcagaa

SEQ ID NO: 7618 - DNA, 551 bp, Homo sapiens
gaagaaggggcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcagcggtctgtatggacccaggcttgtcaaactgtactatacacatcgtgacagtcaccattaacggagatgatgccgaaaacgcaaggccga

SEQ ID NO: 7619 - DNA, 362 bp, Homo sapiens
gaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggaaccatacacaacactaaaggacgaacctgatctcttatactagtatccttagtcatttttattgccacaactaacctcctcggactcctgcctcactcatttacaccaaaaa

SEQ ID NO: 7620 - DNA, 86 bp, Homo sapiens
aagaacggctttctgctgcaatggagagaaatcataacagacggtggcacaaggaggccatcttttcctcatcggttattgtccct

SEQ ID NO: 7621 - DNA, 582 bp, Homo sapiens
gcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctagacttcgagcctatgccaaaaaaggctttggcaaggagcatgccaagtggaaccctact

SEQ ID NO: 7622 - DNA, 557 bp, Homo sapiens
ggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctaacatgctcttcctgctctatctgca

SEQ ID NO: 7623 - DNA, 463 bp, Homo sapiens; identical to SEQ ID NO: 2359

SEQ ID NO: 7624 - DNA, 651 bp, Homo sapiens
tcgtcgacccacgcgtccggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatg

SEQ ID NO: 7625 - DNA, 595 bp, Homo sapiens
tcggcacgaggggcactttttaaaaagtttatatgaggaaacaaagaagacttgctgtgatccagcgacatgcccagtgagtggaagagaagaaactggaattaagctattctgtgtgccacttaggtcaggccctccactacatggtcctgcttctcttgcatgagttagctactcatatcatgagagcatccctttcttatttttctgcgctagtggagcagagccatgtatgtgctatggcccatatgttgaaacttgtttatctacagctagccagatggtctgtaacagcacacaaagaagccatttggaaactttcagagggtcagcacgttttgaaaacaactcagagtaatgcatattgtgatgtcattgcttactttaagcttacagtgaggaatatcttgttaggtactgaatgtgaaacatgcagactttgagaaccaactcagaggtcctagcccccagagacagaaatttatttaattggatcaccctttagacttgttttgtctacatgttctctgaaaaaggaatataatgtcttaatttaaaatactttgttttttaagttgctgctgggttaaataca

SEQ ID NO: 7626 - DNA, 612 bp, Homo sapiens
gaataagcttgcggccgcaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaa

SEQ ID NO: 7627 - DNA, 534 bp, Homo sapiens
gcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcat

SEQ ID NO: 7628 - DNA, 660 bp, Homo sapiens
cgcccttgctgtcactgctgcttctgatgcctgtccatccccagagttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggcca

SEQ ID NO: 7629 - DNA, 345 bp, Homo sapiens
aagtgctgctgctgggtctgcatacgcgatggataacgtgcagccgatataaatctcgccccttctgctttagtgtgaaaggccacgtgaagatgctgcggctggatattatcaactcactggtaacaacagtattcatggctcatcgctatctgttgttggacactgataccatgaaaccacaacattgacaggtggtggaggggtgtttgcacttgtgacagcagtatgctgtcttgccgacggggcccttatttaccggaagcttctgttcaatcccagcggtccttaccaaaaaaagcctgtgcatgaaaaaaaagaagctttgtaatgttatattacttt

SEQ ID NO: 7630 - DNA, 305 bp, Homo sapiens
cccatttaaaccccccccttcaaaccaaaggggggggattacaaacttgacccaccgagcccggccggatttttgtttttaaaaaaaccccaccctcctcctaatttttttttataaaatccctgcttaaaaaaaaaaccacaagggactccacttgttttaaggctttgaaaaggaaaaccaaaaatttttccgggccttttggcaataataaggggttgacccccccccacccaaacccagttggaaaaatccaaacttttcaccccaacccccctaatataggggaggcttttactcacggg

SEQ ID NO: 7631 - DNA, 485 bp, Homo sapiens
aagcttgcggccgtaaacctttttttttttttttttttaaaccatttaactttttttttaaaaaaaaagggggtttttttgtggcccaaatgggtttaaaactccggacctaaagggattttcctgactccttaagggtgggaataacaagcttgaccccccccccccagttgaatttaatttttaaatcaaagttcaaaacaataaaatttttccccttggggggccctgccaaacaaattgaacaaacagaacctgttttaatatttaaaagggggaaaaaatcccctcaggttgggggcaaggaatggcttaaaggaggggccttttttgacctgattttgaaaaaccacccaaatttccggaaaccaaaagggttcccaaaaagggggggtaaaccaaactgaagggaggcagctttttcctctttggcccctggaacctcctgggaagaaaaatttgattttcccccttttttgaacccc

SEQ ID NO: 7632 - DNA, 551 bp, Homo sapiens
tcatcgagacctcatcgatcaagagccatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactgcacgtgttagttggcatcccagtttcttaaacaaatagtatcacctgcttcccatagccatatctcactgtaaaaaaaaaaattaataaactgttacttatatttaagaaagtgaggatttttttttttttaaaaataaaaccatggtcaaaggctgcaaggattt

SEQ ID NO: 7633 - DNA, 431 bp, Homo sapiens; identical to SEQ ID NO: 2360

SEQ ID NO: 7634 - DNA, 454 bp, Homo sapiens
gtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagaggttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttct

SEQ ID NO: 7635 - DNA, 519 bp, Homo sapiens
ggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggta

SEQ ID NO: 7636 - DNA, 424 bp, Homo sapiens
gacatcaaagttgtttccagttgtgctgagacagagcaatgggtttccttcttttacatccttgtgcattgctctattgttatggatgataaatttctaaaagtaaaatcactgggacaaaggatacacacacacacacacacacacacacacactcttttttgtgacaggatctcactctgtcacccaggctggagtgcagtggcgcaatcacagtttactgcatccttggcctcccatgttcaagcgatcctcccacctcacactcccaagtagctgggaccacagcgcacaccaccatgcctggataattatttttctcagtttttgtagacacacggtctccctatgttgcccacgctggtctcaaattcctgggctcaagcaattctcctgccccaccctcccaaagtgctgggactat

SEQ ID NO: 7637 - DNA, 423 bp, Homo sapiens
aaaatacaaatattagccgggcatggtaagtgtccccctgtagtcccagctactcaggaggctaaggtatgagaatcccttgtgccctggaggcggaggttgcagtgagccaagatcgtgccactgcactgcagcctgggtgacagagcgagattctgtctccagaaaaaacaaaaaatataagtgatgttaacagagggacataaggtattttcagttcttgagaaaaagtcgtaactggattcatttcagaatcttgggagtaggagatggattggtggagggtataaaagaaaccatgtcggctgggcgcggtggctcatgcctgtaatcccagcactttgggaggccaaggcaagtggattgcctgagcttaggagtttgcgaccagcctgggcaacatggtcaaacccagtctctact

SEQ ID NO: 7638 - DNA, 379 bp, Homo sapiens
gacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttccca

SEQ ID NO: 7639 - DNA, 488 bp, Homo sapiens
gaagggtacggctgcgagaagacgacagaagggtacggctgcgagaagacgacagaagggtacggctgcgagaagacgacagaagggtacggctgcgagaagacgacagaagggtacggctgcgagaagacgacagaagggattggaagagatgaagacaaaccactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagtttatcccagcactttgggaggccgaggtgggcagatcatgaggtcaggagattgagaccttcctggctaacatggtgaaaccccatctctactaaaaatataaaaaattag

SEQ ID NO: 7640 - DNA, 547 bp, Homo sapiens
acagaagggttattttctttttttaaatgacggcttaatggccttcagtcacctacagggaggctctgccattcctgtttgtggggctccatgtctgatagcatcatgtggtcacacagcacaaaatcatgatttactaggaccttaacaatgcatggtaaggcctttgaaaacatttttttacatgtccactgggacctgttgtgtcagttcataggatttttacaaaacacatacaaagaacaaataaaatgaccccagtcccaaaatgctctacaagtgcttattgtttgatatggaatgaagacaaaatcaagcacattccgttgttccagaatatgaaactgctccacagagtttcacattcattgggtttctgttgctattttgatttttctaaaagtgtgacatcctgtatcttagtggtgtgaaactgaaacaaaccaatacaagaggttccaattgtaagaatatacaattttgaattagtcacacagatgacagaagtgtaaaaatgttttttggcccaacgttacaaaatatttgt

SEQ ID NO: 7641 - DNA, 467 bp, Homo sapiens
gggctggccaggctggtcttgaactcctgacctcaggtgatccgcctgcctcggcctcccagagtgctgggattacaggcgtgagccactgcacctagcccttcttttttttttaagaactttttttttgaaatggggtttcactgtgttgtccaggctggtcttgaactttttcctagggtcaagcacccttcctgccttggcctcctaaagtgctgggattacaggcataagccaccatgcccagcccctttttgttttcttaaaatgaaaaagttctagttatgggacttgtaaaaaacattatttgcaggtccaaagcacacatttgccgatggtcagtccaggacttagctgtgacaccatgctattgtcaggatacagtttactagatacgggatcctagaataggaaaaaaataaacctggtttaggggatcaaaatggctatttttagccatccaactc

SEQ ID NO: 7642 - DNA, 340 bp, Homo sapiens
tacggctgcgagaagacgacagaagggtacggctgcgagaagacgacagaagggtacggcggcgagaagacgacagaagggtacggctgcgagaagacgacagaagggtacggctgcgagaagacgacagaagggtacggctgcgataagacgacagaagggtacggctgcgataagacgacagaagggtacggctgcgagaagacgacagaagggtacggctgcgagaagacgacagaagggtacggctgcgataagactacataagggggactgtgactgcgcctggattctgccattgcgacacatttttgtgcctttcagcccctggtgtctgcag

SEQ ID NO: 7643 - DNA, 145 bp, Homo sapiens
aacaggttttctatttattcattctccccacccccccgagatggagtcttgctctgtcacccaggctggagtgcggtggcatgatctcaactcactgcagccttcgcctcctgggttcaagcggttctgctgtctcaccctccct

SEQ ID NO: 7644 - DNA, 207 bp, Homo sapiens
gacaaaaattagctgggcatggtggtgtgtgcctgtagtctcacctactcgggaggctgaggcaagcttaacccgggaggcggagattgcagtgagctgagattgggccactgcactccagctggggcaagagagcgagactgtctcaaaaaaaaaaaaaaggtttgtaatttaaagggggccaacgggggggaaaataatttgggg

SEQ ID NO: 7645 - DNA, 616 bp, Homo sapiens
aaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgggggtctgcagaacctggtgaacctgcgggagctgtaccttagccacaatggcatcgaggtcatcgagggcctggagaacaatgtgca

SEQ ID NO: 7646 - DNA, 478 bp, Homo sapiens
acaaactgatgatgcttgaattcctgtttactctgaagttcttttcacatgctggtgagttctgagcaccatgcttacatgcacctctcctttgcagcaaacataagttttgaggtccctgtgagtcctaatggcaccgaggtgctgtctcaggggaccttctcctaatcctgaaaaagtctccatgattggccctggaggagttctcctggttgtctggaatgagttcatactaatagtcagggctctgggcattgtgagaccctggctactttctttctttcccacaatgtatactttctcactatttatttatttatttttttgagacagagtctcgctctgctgcccaggctggagtgcagtggtgtgatcttggctcactgcaacctccacctcccaggttcaagcaattctcctgcttcagcctcccgagtagctgggaccacaggcgcccgcaaccacgcccggctaattt

SEQ ID NO: 7647 - DNA, 534 bp, Homo sapiens
ggctgtcgccgcgcagagccggagcaggagccacggccgagagaagtgggataactggatcagagggtgattaccctgtgtataagagtatgtgtctcactgcaccttcaatggcattgagtagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaa

SEQ ID NO: 7648 - DNA, 509 bp, Homo sapiens
acagaaggggaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaag

SEQ ID NO: 7649 - DNA, 58 bp, Homo sapiens
tctttctctttggtttattgatttggtttaatttccattatgctattttgcataatca

SEQ ID NO: 7650 - DNA, 562 bp, Homo sapiens
gacagagggggcttggcccaagatggcggcctccgtgtgcagcgggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatcccctttttttccatcaagctgtagcctgc

SEQ ID NO: 7651 - DNA, 91 bp, Homo sapiens
ctcatctcatggctctggggctgggtccatggctggcagtggaaatccctgatctgattcagaagggcgtcatccaacacaaagagaaatg

SEQ ID NO: 7652 - DNA, 313 bp, Homo sapiens
agcaccattgcgctccagcctgagtgacaaagagcaactctgtctccaaaaaaaaaattagaaatgtataataggtaaacatgttacatatataaagtatcaattatcatgtactttgatttttaaaagatgagagagtatatgtcattatgatattctaaccaagaagggaacctttttctgtctccatttttactgattcagaacatatattttaattgtagtgaggttttatgcctcaacttgttaactctggtatttacagaatttttgttctttgtatattagcatataatgtcatagttggcatttg

SEQ ID NO: 7653 - DNA, 432 bp, Homo sapiens
tgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgaaaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatg

SEQ ID NO: 7654 - DNA, 593 bp, Homo sapiens
acagaaggggaggtctggttttttgggctgcagtatgtagacagcaaaggttattctacatggcttaaactaaataaaaaggtaacacggcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaaaaaaaaggaactgaattgtggctaggtgttgatgctttgggtctgaatatttatgagcatgacgacaagttaaca

SEQ ID NO: 7655 - DNA, 344 bp, Homo sapiens
acagaagggcctgggcaacaagagtgaaactccgtctcaaaaaaaaaaaaaaaaaggttttttttttttttaaggttttctacccaccccttgttcttgggcaagaaatttttttttaataggggggttttccaaaaaaatttttgaaacccattttttttaggctttttttaaggtttttgggggtgggggggggggaattttttatgaattccccatttttttatttttaaaaaggaccctggaaattctttcccttaaaaaaaaggccgccccctctaaataatttgtgccccaaatttcacccacctcttttaaaaacacaaacctttttttaaaaaaag

SEQ ID NO: 7656 - DNA, 496 bp, Homo sapiens
acagaagggataaaaagaaaaacctggctctctgcttaaggccaagaaacctggcattaatggaatcaggaaaagaaaagcagttgccacaaatcaaatcctttcatagggtatatctgtctgttattcctttgacatctgaaaattgccacatattgggaaagagaaatcattgcctttcttcatgtccctccagcacagttgtttctgagctgcgctgtctctaactgccagctcatgtacgctccttccagagagtcattctgtctgcacttagaggaaagaaaacatggactccttgacaccacgtctctgaggactcatcttgtgtcttccatcctggcacaagaaccaagtgtaccagacagcctttgaggctgaaaagagatcgaggaacagcaggggaaaggcaaatagcacaatatttgtttccacaactgatgtcactacaatgaatatgaaactcagaattttctgttaagtcaagcactagctg

SEQ ID NO: 7657 - DNA, 560 bp, Homo sapiens
gagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatat

SEQ ID NO: 7658 - DNA, 85 bp, Homo sapiens
gaaggtaacttcattttgtctatttgctgttgattgtaccaagggatggaagaagtaaatatagctcaggtagcactttatactc

SEQ ID NO: 7659 - DNA, 494 bp, Homo sapiens
ggtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgac

SEQ ID NO: 7660 - DNA, 193 bp, Homo sapiens
gtagcagaccctgtctctttaaaaaaaggaaaaatgactgggcgtggtggctcatgcctgtaatcccagcactttgggaggccgaggcaggcggatcacctgaggttgggaattcgagaccagcctgaccaatatggagaaacccccgtctctactaaaaatacaaaattagccgggtagggtggcacatgcc

SEQ ID NO: 7661 - DNA, 589 bp, Homo sapiens
acagaagggatgagtgcctaatccacttgtgaaaattaaagaaaggggatcttttttatgaaaaacacctaatatggaaagacataaattgtaataaaaagtgttagcaccttgcacctcctgctaattgcattcctagtcaagaggaagcaaaattgtataacaaatgtcagaggtacatcatgaacaaagtgcaaagaattgtctgttcctttcaatagtgaattgaaaaagagtagcaaacctgtttaagctatgtatagtagctttaattttggctcctaacctttctgggactcatctatttcatttgtctaatgaggataatagtaacccattcaacttactgtacacagactgtactgtacacagactgtttcttcattatattcattaaagatggatttaacattaattcattcattcacccatgtattttttagtttaagaaatatttttgggccagacgcagtggctcacacctataatcccagcagtttgaaaggccaaggcaggaggatcccttgagcccaggagtttgagaccagtctgggtaacatagcaagatctcatctctactaaaatttta

SEQ ID NO: 7662 - DNA, 385 bp, Homo sapiens
ggttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttgaaaatctttccttccaaatctgttgcccactgaacagccacccgtccctcactgtcctggtgtccaattgggctggatggtgttggggcatgatgtgtgga

SEQ ID NO: 7663 - DNA, 535 bp, Homo sapiens
gtaggacacccatcttaccggccaatgtccaaaattacggtttgaacataattggagaacctttccttcaagcagaaacaagcaactgagggaaaaagaaacacaacaatagtttaagaaattttttttttaaataaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatg

SEQ ID NO: 7664 - DNA, 419 bp, Homo sapiens
gagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttaccc

SEQ ID NO: 7665 - DNA, 503 bp, Homo sapiens
atacatcccaaagagaaagattatttctccacgatctataaaagatgtgcttcctcctgttgaagaggctgttgacaggtgtctctacctactggaccgttttgcacagcctgtgacaaaggataagtttgctttggaatctgagaatatttcagaaccatactttacgaacagaaggactatttctcaacaatctgcagaaaatttagatgctgcatgtggcattgacaaaacagaaaatggaaacatgtttgaagaccaaaatgttgataaggaaggaaaagcactaccagcaactggacaaaaagcaaatgtgtctcctgagcaaccgcctttattcacgaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttc

SEQ ID NO: 7666 - DNA, 637 bp, Homo sapiens
  misc_feature 328: n = A,T,C or G
acagaagggcatttgacacagtgggagcagagcagatcggaggttgagtaactctttcaaagacacccagtgagcccagggtggggccagagcacaatgctggggcgcctcgactcccgacccctggccctttccaccggaccccactgccgctccttaaaaggcaccgtttgccacgcactttctaaacacattacctcatcgaattccactcttgtgagctatactgctttccttttgggacaaggttttcaccattttgagccccagttgcaccatctccaagttggggctcatgacagtccctgcaaatgaggtcacggctcancaggtggaagcacgctggcaccgattggaagttccagaagtgttatctgtgtggctttctcctttcccctacccccagccacatcttaaacaggaaacaccgggcttcccaagccacttctgagcgcactctcacgcttacctctgtggcagccgacggagcgtctcctgggagcaagaacactcctgctagacagctgttaactaccaactggaggacaagccagttctccaccttcagccagcttgctgggtgagcttaggagttcacagcaaacacatggacacatctaaagtctaaatgctacag

SEQ ID NO: 7667 - DNA, 333 bp, Homo sapiens
cgagtagctggggttacaagcacccgccaccacgcccagctaatttttgtgtatttagtagagctgggttttgccctgttggccaggctggtcttgaatgcctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacaccaggtatt

SEQ ID NO: 7668 - DNA, 457 bp, Homo sapiens
tcttgaatcacacctaccaggtcaacttcttgtgtctgtgacttgtgcggtaggattggtctgggaatgaatctaacaggcccttttggctttgtgaagacttgttactacccaggttgtctagcattctgagctgtatggggagcgcagtcatattttggctgtatttcactggcagtagaaatcttgacattccaatttcccttgaggggtagtaattgtttaggggttgaaactggagaggaatccaacatctggacatggcaggtacagtagcattggagtctggcagacttgagcccagatgactgttccgcaactaactaaacaatatccttgggcaagtcattttcttcatctggggctctggagggccgtctttttcctctgcctagatattctggcttgtgtgatagctcaacctttaggaattgttctggattactgctttttatct

SEQ ID NO: 7669 - DNA, 195 bp, Homo sapiens
acccacagaataaaacccaatgttcttaatatgtagtcttaatatagactctataaatagcccctttgttaatctatcttgaattactcacttttaggattcagctccctactgagaccccaactggctttaccttctgttccctcctggttctgcttatcttccattgcccctgtggacctgctttctgtcatt

SEQ ID NO: 7670 - DNA, 299 bp, Homo sapiens
atcattttatttattaagtccagaaactgattttaggggtagagggatgagttgtgctatttaatcttactctggcggataaataaacatatggattcaaaggtgttgagtgagagaagactcttgatatgttagaagaccactgctctaggatatgtgtagaaacaaaactgacacataggaagtacttaatgaatgtttgttgaatgaataaattttcaagcctgcctgaaatatctatgtgacatgtgtcgacacatacagcccctctggtactcagtatcatattctgaaaaatg

SEQ ID NO: 7671 - DNA, 594 bp, Homo sapiens
ggggataggagcctctctgcctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaagaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgatt

SEQ ID NO: 7672 - DNA, 523 bp, Homo sapiens
gtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaacca

SEQ ID NO: 7673 - DNA, 509 bp, Homo sapiens
acagaagggatgagtatttgggacgagaacaaagcatattgaaaccgcaaatgatgtgagattgtgtcaggctttgtgttgggcaccaagcaccttaagatagtcagatataatgatggttagtgaatgtttgaaataaatcaagtggtaatgttttaggttgcaaataaggctcatgaaaataattatttggaggcttgagaaaaatgacttttaaaatggagtcactatttttaaaacacaatactcttttattagaaaaagtttgataactctgatataaatattccaacgatgcttgtgtacaatacttaaagcttttagtgaaaatagtttttatttaaatatttcccctggccaagtgtggtggctcacacctgtagtcccagcactttgggaggccgaggcgggtgggtcacctgaggtcaggagttagagaacagcctgggcaacatggtaaaaccctgtctttactaaaaaaacaaaaattagctgggtgcagtgacgca

SEQ ID NO: 7674 - DNA, 576 bp, Homo sapiens
acagaagggattcggtaggtctgggatggtgatggggatgggacctcagaatgtatattgctaacatgctcccaggtaatgctgatgcttcaagtcttggaaccacacttcgagaatcactgttataatgtacagcagaactgcatgatcaggtaagtgtgctgagctgttgatcctcctcattcctgagctgggtgtgtagagacaagagcaggagactaggggctgatgatcttttagtcacatccatttaccccagagtgctctatacaaatagcatttttatgtattccccggcatgaaaaagctggaaagcaccaagagaggttggtgttaaacaacatgaagttttggaatctcagaaagtctgaatgagttaatttttttgagctttagcatacttatcattttataatgaggataattccttaaagcaattctgtccaatagaactttgagatgatagaaatgttctgtatctgagctgtccaatggtgtagccactagtcacatgtggcttttcagcatttaaaaaatggctagtaaggttggggcacagtggcttatgcctgtata

SEQ ID NO: 7675 - DNA, 349 bp, Homo sapiens
ctcttagctagtgggtaaaaaatcagatgtcatttaaattcaacatattttaatattctaaattcaggaacctatgtattttcttttctttttttttttgggggctaaaacaggaaatttttccttatttcattaagttagccggaggttttttatttttatttttgaaacaaagtttcactctcatcactgaggctggagtgcaggggcatggtcttggctcactgaaacctccgcctcccgggttcaagggattctcctgcctcaccctcccaagtagctgggattacatgcacacaccaccacccctggctaatttttgtatttttgggggcaatggggttttacc

SEQ ID NO: 7676 - DNA, 517 bp, Homo sapiens
gaaggggagtgcctgacctcaagcgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacaccaggtatttctctaatagagtatgtgccacactttctgctaactgcctgtttatcagtgtccccacatcccaatatctggttccttcaagggcagggagcacagggtatggcgtcagagtggtactcagtgatgtttactggtgggtagaaggaagggttagtccctgtttttgaagactttatgttctagcaggcagaaatgaagcacaaatagttcaagaaataaacaatttaagaataaagtcatttggtttgcttcgcagaaatgtcttattgctga

SEQ ID NO: 7677 - DNA, 223 bp, Homo sapiens
agatgcgagatgttattttgagattctagtatttggcatagcatttctcaatgtatgttttacagaactttatttccctgagatgctaataagcatttcacaaaaattaaaaaggattacattgtcagatgagtttgagaaagagttgatttcacttcactgtagaactcagagcctttggtatgctaatatgggcacaattaatatagtatgcgtgtttttc

SEQ ID NO: 7678 - DNA, 518 bp, Homo sapiens
tgctaatttttattactttctttactcttttagaaactagattttagcattggaactagaaactattttcggaaattaaatcttagctttgaaattaaatacccgcttttttctggagaataaagaattatgaataaatgaattattctgattaaaattattctgattaaaatgaattattctgaataaaaaatcctgatgtacattgaaaaggtttattagattgtatacaatttctaggcagggcatggtggctcacacctgtaatcccagcactttgggaggccgaggtggggagatcacttgagcccaggagtttgagaccagcctgggcaacatggcaagaccctgcctctactaaaaatacaaaaattagccgggtgtggtggtgggtgcctgtaatcccagctgctggggaggctgaagcaggagaattgcttgaacccgggaggtagagattgcagtgagccgagatcgtgccactgcattccagcctgggcaacaagcgaaactcagtc

SEQ ID NO: 7679 - DNA, 574 bp, Homo sapiens
ttaaaagtgaatagatccctctcaatatcaaaggctctgttctgttttgtattgtgttatctgatggttttaaggttttggggcatcagaaattactttgcattatgagagaactttggtgtgtaataactaggtagaaaatatactttaagtgttggctaatagtaactatgaagggatacttaactctttgcacatttgaattgaagaagcatggttttggccacctgaaaaatatggaaacatccccaccacctattaagagatgagacttccatgacagatgggctaattacaaaattgattgattggctttgggttgccttgcaatgaaatgaatggtagaagcaatgcactgtcttctcccttgctatctccctccttttgggaacccaagatccaatataaaatagcacacttaattttggcgatctgcctttgcttcactgtgcctgcttattaagccctaaagatgcatgctttcctggccctgttcctccaaaggctccaccctgaagccagtaatccaattaagaaactagaaataaaaaatcttacaaacactaaatcttca

SEQ ID NO: 7680 - DNA, 601 bp, Homo sapiens
gacagaagggagtgaataaaagcgtattgtaatttcatgtctgcttcagatcatggggacagtaccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgc

SEQ ID NO: 7681 - DNA, 536 bp, Homo sapiens
ggggatcttgacgttcatagaacagtttgttgttgataaaatgcagttgtgctataaggaagctacatttatattgttttgatactcttaaagtgtccaatctctaggtgtatttgattgggaaaatagtaccattgtggttgaaatgctctgatggaagactcccattataccagcatcagcagtgtggaggggccggccagtaaagtgatctctctctggttggaatatgtagagaaaaggagacaacaccgtcgcccagaagtggaggttgccatattacttgcacaaacctcatgccgttaggtcttcagccacagccgatatttgcagagatgtatctccagcgatctatctccagagatggaacctggagaaatgaccaaacttgacacagccttcaatggttggataaatagctcattaacccaattagtagagaaagctgtgcaatccaagcactagcactgtttgtaggagttattaatggagaacacaatgtattattaaggggcaggggtttttgtttttctttt

SEQ ID NO: 7682 - DNA, 104 bp, Homo sapiens
cagaaggggatcaccaaacataacgatgatgagcagtacgcttgggagtcctcagcagggggatcattcacagtgaggacagacacaggtgaacctatgggtcg

SEQ ID NO: 7683 - DNA, 203 bp, Homo sapiens
agaaaagtcatgtctatacatttgcatatattattaaagatatatagtatgtaaatatattttttagacaatagcttgtaaatgcaatttaattttttttcctcttcttgctgaatttttttttttttttaaaaatcggaatttggcccaaacccgggggttcacccctaaaatcccacccttttaaaaggttaaggcaggcg

SEQ ID NO: 7684 - DNA, 611 bp, Homo sapiens
gaggctataacttggtctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagagtctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatat

SEQ ID NO: 7685 - DNA, 376 bp, Homo sapiens; identical to SEQ ID NO: 2394

SEQ ID NO: 7686 - DNA, 532 bp, Homo sapiens
agcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctgaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattc

SEQ ID NO: 7687 - DNA, 603 bp, Homo sapiens
acatgcccactgtggagctcctgaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccctttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgat

SEQ ID NO: 7688 - DNA, 493 bp, Homo sapiens
  misc_feature 189: n = A,T,C or G
acagaagggtttattcttaacactaaaattaacatgccacacgaagactgcattacagctctctgtttctgtaatgcagaaaaatctgaacagcccaccttgggtacagctagcaaagatggttacttcaaagtatggatattaacagatgactctgacatatacaaaaaagctgttggctggacctgntgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaat

SEQ ID NO: 7689 - DNA, 89 bp, Homo sapiens
gttgtttatgggaacaagtttgcagagaaaaaaatggttgaatagaaatagaaggggtcggccgggtgcagtggctcacgcctgtaatc

SEQ ID NO: 7690 - DNA, 229 bp, Homo sapiens
gggagtgagcatttgcagaagccctgaggctggatcaagcctgacaagtttaaggacccacacgcagagcagtggtggccagagagctgggagtgacgtgtagagagtggtgagggatgaggacaggatctgtcaagtctctcagccctggtaaaagatttgggttttactctgcatgtgctgagtcctttggagggtgacaaaatatttgcaaatcatatatttgatg

SEQ ID NO: 7691 - DNA, 586 bp, Homo sapiens
aggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtc

SEQ ID NO: 7692 - DNA, 84 bp, Homo sapiens
gattccactcatagccctggttcgttattgttactcatggctctgacgtccccaagccctcttgaatgttgcaagcaatgttaa

SEQ ID NO: 7693 - DNA, 510 bp, Homo sapiens; identical to SEQ ID NO: 2397

SEQ ID NO: 7694 - DNA, 484 bp, Homo sapiens
aaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaatgaaaaattgtacactttctgattttaacttcactaatgtaattactctctcaagaa

SEQ ID NO: 7695 - DNA, 146 bp, Homo sapiens
ctctgtcgctcgggctggaatgcagtggtgtgatcatatagctcactacagcctcgaattcctggactcaagcaatcctcttgcctcagcctcccatgtacctgggactacagatttggaattatgacatctggacaaacacatat

SEQ ID NO: 7696 - DNA, 569 bp, Homo sapiens
aagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtct

SEQ ID NO: 7697 - DNA, 157 bp, Homo sapiens
gcgacagagtggcaccctgtgtcaaaaaattaaaaaataaataattttgttgtgtccttgttagtgtccaaaattcactggagagattctttcagaattgtaaagtttaattaaaagtgttaggtttgccgggtgtggtggctcacacctgtaatcc

SEQ ID NO: 7698 - DNA, 77 bp, Homo sapiens
ggaagtctatgagaaagtagcatttaattaaagtttaaaaaaaaaaaggttgggcgttgtggctcatgcctgtaatc

SEQ ID NO: 7699 - DNA, 307 bp, Homo sapiens
tattgctttttctagctgatgattaaggttgagaggcagaagtacattgtgtcagggaggacctttcccttttatgcatgcacctggcatttatcacctttaacaaagtgtgtgtgtcatgctgtgctgcttgcttaaggggctgtatgcctccagtctgagtcacatggtaactgcatcagcagtcttagcctgtagcattttattatttcttttcaaagtttacacttggcctaatacttagacattttataattctttacagtaaatgaaactatacatgagaagatgggcatacctttggatt

SEQ ID NO: 7700 - DNA, 64 bp, Homo sapiens
ggcctggtatacagtaagcgcttaaaaaatacatgtcaaatggctgggtgcagtggctcacacc

SEQ ID NO: 7701 - DNA, 574 bp, Homo sapiens
gagatccactgattgcaatgcaatgggacaatatctggaagcaattttatccagaaaaatcaatagctttaaaacaattcacaaccttggacctaatacctctacttctaggaagctagcctatgaaggtttctgctgaaggatgtttatcacagtattatttataatgtgaaaaagccaaagaggagacctaaaatgtttcaaagatgaaaatggtttgataaaattattttttttttgagacaaggtctcactcttgcccaggctggggtgcagtggtgcaatctcggcttaccacaacctccaccttccagattcaagcacttctcctgcccagcctcccaagtagctgggaatacaccccaccatgcctggctatttttttgtattttagtagagatggggtttcaccgtgttggctaggctggtgtcaaactcctgagctcaggcaatccaccttcctcagattcccaaaatgctgggattacaggtgtgagccaccgtgcctggcgataaacaacatatttaaactctaaaatgttatgcaagcattccaggcatgctttggaaaaac

SEQ ID NO: 7702 - DNA, 475 bp, Homo sapiens
gagagctgcaggccacaagtcccagggcctctggaagctgtcactgcctctgaaatccttgcagaaggctttcagccttacaaggcctgtgggtgagaccttgccccagaccatgggctccttcagcctcactctgcctggtatctctgggctgggcacagaggaacatcagggtgaacgaatgaatgaacagacaatgcacacatcactgggtgatcttggagaaggtgcctctgctccctcacatgatctgtgacacccagatttggcaaggcccagagcagtgagtgttgtataagttttgccatcctggtcctgaagcagggcccagcttggtgctgtgagaaacagcccacctttttgttacctcctgtgtctctatgaaggaggactggaagaaaccctactgacagggcctatcatcttaaaggaatattttgggctgggcgcggtggctcatgcctataatcccagc

SEQ ID NO: 7703 - DNA, 541 bp, Homo sapiens
  misc_feature 423: n = A,T,C or G
tgtatggcagtgtaccaaacatatgtaaattccatgaatgacaaaatccgcaaacagatcaacatcaataatccctttgttttcaaacacattagtaacctcaagagcatggatcattttgatgacattggtcccagtgttgtaatggcctccccgaggcgtgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccntggagaacagaatgaaatggccagattgaaagcagcactgattcgagaatatgaagataacgatgaagttcacatagaggttcataatcctcggaatacagaagcagtgaccttaaac

SEQ ID NO: 7704 - DNA, 559 bp, Homo sapiens
gacagaggggagacgtcagtgcgggtgctaccccggcaggaatcgagcttatatcacgaaggctccttctcacctccggacgtgagaattacaggcttggatctcaaaccgccgcggtgtcctcatgacttctcttgtggaccatgtccgtgatcttttttgcctgcgtggtacgggggggggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccggcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttgga

SEQ ID NO: 7705 - DNA, 577 bp, Homo sapiens
  misc_feature 477: n = A,T,C or G
acagaagggtagtgaaacaaagccagagcatctttgtatattgcaatatacttcgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttntttatttgaataactcattcagttgtgaatgaattcctctttatttggtgccacagtcaccaaatgacaaggatttgccactttcccaccaaattgtgag

SEQ ID NO: 7706 - DNA, 84 bp, Homo sapiens
acaaaactcctgtgcttttgagcaaggacttttgccctctagaaagcaactgaggccaggtgcggtggctcacgcctgtaatcc

SEQ ID NO: 7707 - DNA, 534 bp, Homo sapiens
gttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagattttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaa

SEQ ID NO: 7708 - DNA, 564 bp, Homo sapiens
attgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaggacttgtca

SEQ ID NO: 7709 - DNA, 108 bp, Homo sapiens
aagcaaaaagaagcctcgaaagtgaaatgtatctggaaggtctgggcagatcacacattgcttcccccagtccttgtcctgacagaatgcccctaccatcacccactg

SEQ ID NO: 7710 - DNA, 542 bp, Homo sapiens
  misc_feature 147: n = A,T,C or G
acagaaggggaagcacagtaaacgcaagaggggatttgtgtacaaaaggcaaaaaaagtatttgatatcattgtacataagagttttcagagatttcatatatatcttttacagaggctattttaatctttagtgcatggttaacangaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttcctttaggtttaagtcctgtctgtctgtaaggcgtagaatctgtccgtct

SEQ ID NO: 7711 - DNA, 587 bp, Homo sapiens
gaggccggaggaacaaagcagtcaggagcgataaaggcaggtgatccctgctggtttgccctttctcccagctctgaccgtcaccgtcacacatgacattcttgaatgaggtcacctgctcactacagattctaaaaggggcttgcttggcaaagacctccagggtcagagtgccggcctttactgtttttggcagttgtgtgcatggaacattggaagcgtttggaacggaatgcttaaggaagatattatttggcagcaagaaaaagggagtgtgcagactccccctacccctcctgggatgagtaggtactgcctgcccgttttttctctacaggagttgaatagtagccagagtacaggcttggcatcagaaggccttagttcaatccttatctcttctacctaccagcagtgtggctttatgcaagctcttgttcatctgaaccttaccgctcttgtctgtaagggatagcaatatcggttttacagagtgggctgaaaggttaaaagaggcgctagttctttttggcatgcagcaagtataaagtaattgttgctgttcacctcctctccatgattaaaga

SEQ ID NO: 7712 - DNA, 239 bp, Homo sapiens
caaaggagggaaacaaaactgaattagaaaactattgtagcatttgagggaggagaggcaaaaagcaatactgaaaaccaagatatcttacttctctacctacaaccttctttgcataaaatgatctaatgcgggccatgtaaatgatatcaactatagaataagccaaccaattttggaataaggagaggtattaaaatagatggctatgatttaaatctcctgaacggaaggttaca

SEQ ID NO: 7713 - DNA, 96 bp, Homo sapiens
gcccctgttttctggcaggtgccctccttggaaactggttttggctctgatcagcggttctttttgcagcaaagcctgcatctgtgttgacttgca

SEQ ID NO: 7714 - DNA, 590 bp, Homo sapiens
gacagaagggagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaataatcagccgtggggccaattttttaactcagatcttgctgagaccaggagcatctgatttaacaggaagtttcagattataccg

SEQ ID NO: 7715 - DNA, 423 bp, Homo sapiens
ggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcaggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcaccc

SEQ ID NO: 7716 - DNA, 588 bp, Homo sapiens
gacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctcctccctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaac

SEQ ID NO: 7717 - DNA, 118 bp, Homo sapiens
atctgaacacacaatagctaagacccaaactgggattagataccccactatgcttagccctaaacctcaacagttaaatcaacaaaactgctcgccagaacactacgagccacagctt

SEQ ID NO: 7718 - DNA, 710 bp, Homo sapiens
ttcggcacgagggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccggtgagggaatctgcactccccgctctcctgccccccagccccagcaccctctgcagccctcgcacttgtcagcatctgtcaactcatatccgggccccaaagcttctgcagggcagaagtcaaagactcttaaagatccttacatggaacacttctgttttataattagggaaactgaagcccaagggttataaataagtttgctccaaatgacacatctcacattacaaattgatgacggagtcagggcttgggtactgatcttaatcaatagattgaattctttcactggtattaactgagcacctaggggccaaacgctatggtaggcatttcacacatatgatttcatttactcttcacaaccaaccctgtggagcaggcactattattaacttcatttgacatatgaggaaatggagctttacagagagataattacctgaggccacaagtaataggtggtagctctgggattggaaccaggtcgatctgattcccaagcaatgtctccccacctggctctagactggcaaattgctta

SEQ ID NO: 7719 - DNA, 283 bp, Homo sapiens
aaccccattaaaaaaaaaaagaaaatttcccttttccaaaagtcaaatttttgatgggcccacacttgccctttgcccaaaaatccttttttccaggatcaaacaaaaaaggtcgggggggggggcttttttttttttttttaaaaaaaaaaatgggctggaaaaagctgggttgggaaaaacagcatggaaacccccctggaatctttgaggggctatggtcttgaatccgggggatgaccactaattttaatgggcattactttatggcacaataactttt

SEQ ID NO: 7720 - DNA, 588 bp, Homo sapiens
gctgtattttccctctattttattgtttgtccttgggaatggtccaaaaattttgctacttcactttttatagaaagaggaatttaaagtgtttctatagctatatatttacaatgaaaaatcattcagatagttcagttcacaatgcaactgaccatctagcagcttgagttcaaggtttataaacacaaatgcctaccagcctaagcagataacctgaaagagaagtgggatggtgaagggcgggttggcttaggttgtatgaatgcagaacagggtagagtactctttctaaaagtggatatcaccattcagcaactgaagattttatgccatgcaggaatataatagggtttatactgtcagattttcaattgaagtcagaaatctgaatgtctgggaaattcttgattcttaaatgttggcataaacttaaataataaaatgctttgtgggccaaacaaaacaagcctatagactaaatgcagtatatagactggcagtttgcactcagctttagttttatcctatcacttagatattctaagctgaccaacacagcctaggtaagaatattataaactacaa

SEQ ID NO: 7721 - DNA, 463 bp, Homo sapiens
aaatacatttcttttttattctgacaccgtgctacaacttccattgatgtagaatatgtaaaagaacgacacaagagctaggaccccattatctgaaaacgacgtcgaaccttatagttctcaatcggaagaccttttcacatgcctgttacttttcatattatcatccttcggttttctgacatcatttcttcataaaagtacatgcacactcaaagataggagctgtgtttccaaatgaattgaatctataactcttggcccagcaccatggctcacacctgtaatcccagcattttgggcggccgaggctgatggatcacctgaggtcaggatttccagaccagcctggccaacgtggtgagaccccgtctccagtgaaaataaaaaaaaatcagccgggcgtggtggcaggtaaccctaaatactcgggaggctgaagcaggagaatcccttagaacct

SEQ ID NO: 7722 - DNA, 573 bp, Homo sapiens
tgcggacggaacttttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctc

SEQ ID NO: 7723 - DNA, 228 bp, Homo sapiens
tgagggtgcacgtcttccctcctgtcccagctccccagcctggcgtagagcacccctcccctcccccccacccccctggagtgctgccctctggggacatgcggagtggggttcttatccctgtgctgagccctgagggcagagaggatggcatgtttcaggggagggggaagccttcctctcaatttgttgtcagtgaaattccaataaatgggatttgctctctgc

SEQ ID NO: 7724 - DNA, 440 bp, Homo sapiens
atgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaaaaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgcctact

SEQ ID NO: 7725 - DNA, 323 bp, Homo sapiens
gcaaaggcctgtcttaactctcagtacatcatttactatctagatccagtggacccttttatacacacacacacacacacacacacacacacatacacacataacatattaacttattttacaaataatttatagaattacacccttttatacacacacacattattgcacaaatgattcacagaattaaaataaagtttttcccctgtccctatatttcactcacgcagggtaaaatacagagctgccttctcaattgcacttattctaaaacagaagttagtgagagagcacaccactctaagaactaagtgaacctcttc

SEQ ID NO: 7726 - DNA, 520 bp, Homo sapiens
ggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgc

SEQ ID NO: 7727 - DNA, 631 bp, Homo sapiens
ctggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaa

SEQ ID NO: 7728 - DNA, 501 bp, Homo sapiens
aaccgtgaaaatacttcttcaagttaagggttaggatagggaagaagaagcaagttctgtatgcacaagcaaaaggttggccctcaccatcaaagctcctgtcataaagagtgaatagaaggaaggattgttattattatgactttggttttatttaagtataaaagtatcagcactttaatgctcaaagtatagccataagcaagattagaaaatgtacttgctgtatattgttccagcaacactctgggtttgccctacatttgtatatagttggttttctgtattagtgttttatcatagaccgagtatcatttgtatatttttcaaaattacataaataaatcattttatcattttatttattaagtccagaaactgattttaggggtagagggatgagttgtgctatttaatcttactctggcggataaataaacatatggattcaaaggtgttgagtgagagaagactcttgatatgttagaagaccactgctct

SEQ ID NO: 7729 - DNA, 581 bp, Homo sapiens
ggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccggttatctaccaagagcgcagacttgcatcctgtcactaccactcgttagagaa

SEQ ID NO: 7730 - DNA, 482 bp, Homo sapiens
atgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttagagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatacgctaaaggagcatctatcagattaagttagaacatttgctgtcagccacatattgagatgacactaggtgcaatagcagggatagattttgttggtgagtagtctcatgccttgagatct

SEQ ID NO: 7731 - DNA, 128 bp, Homo sapiens
aagtcatgcttttcaccctattgatggctttcttcagagtctaccttaccatatatacccttttatctttccattacacaaggtggtttatttaagtctgtacatcttggttaatatctggacaattt

SEQ ID NO: 7732 - DNA, 397 bp, Homo sapiens
gctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaatttctgtgctaaacagtgttacagtcg

SEQ ID NO: 7733 - DNA, 546 bp, Homo sapiens
  misc_feature 463: n = A,T,C or G
ctgctgctgcagacctacgtactccgcctggaagccatcatgaatggcatcttgctcttcttctgtggctcagagcttgtacttgaggtgctcaccttggctgctttctccaggatttgaagtacagaatttcagccagcggcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttgtcagaaccagtcccctgctgacctcaagttctcctccttgatcaccgtggccagagcatctcgtgtggaccatctaggctccttgngcttcaagcaggacctgagccacatgctccctgtacgagctgtgctatacctgtcccacatgaacacggagagcctcatgttg

SEQ ID NO: 7734 - DNA, 116 bp, Homo sapiens
ctaactcacagatattctgaaatgccaattcctcctttatcaacaattcctctaacctcgctctcccttccttccttccttccttccttccttcctttctggcttccttgcttgct

SEQ ID NO: 7735 - DNA, 558 bp, Homo sapiens
gacagagggggactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaa

SEQ ID NO: 7736 - DNA, 399 bp, Homo sapiens
gacagaagggaagattcattttattgtcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctccccttgagtattttcctttcttcgctatcttgggactcttct

SEQ ID NO: 7737 - DNA, 393 bp, Homo sapiens
agcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattaaaacgctttgttttacaaaaaatgatgaaagaattcttccacatgtacttctgtgcttaaaacatttttacggacctaagcgctggaaacgttgctgcatgtcggctgggttttttttt

SEQ ID NO: 7738 - DNA, 487 bp, Homo sapiens
gcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaagatcagttcgtggttgcattgtggatgcaaatctgagcgttctcaacttggttattgtaaaaaaaggagagaaggatattcctggactgactgatactacagtgcctcgccgtctgggccccaaaagagctagcagaatccgcaaacttttcaatctctctaaa

SEQ ID NO: 7739 - DNA, 52 bp, Homo sapiens
gcattgttggaaaagaatttatcgactgccacaaagaatcttgattccctgg

SEQ ID NO: 7740 - DNA, 555 bp, Homo sapiens
gtggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttgg

SEQ ID NO: 7741 - DNA, 500 bp, Homo sapiens
agtgggattgcccagcaaagtgcttatcaggtgatgatcccagtgaagtatgtcacagttatgcagtaacttaaggctgctgtaatacggagatacattgaagttcattagtaacttttcagtgacccaaaatggatactttagtggttatataagtataaattagtatattaggtaagggaaagagtttagtgcacctttaaagaaaaaatggttttaattgatgcaccattttattgtatatttctttacatagtgagaagggggcacatgaggtcagcagtcaagttttcaggttaatgtcgtctttgtcacacacctccttttgtgggttggcgatacttttatttatgagctcgaaattctccacttagcacactattaaggtggaaattggaaggctgatatcagtggcctaaacctgaagttctcgtacgttagtaggcatgaataccttgttaagaatctgggccttcatgtaaaaaagattctctacagac

SEQ ID NO: 7742 - DNA, 468 bp, Homo sapiens
agaagggatttccccagagattgttttaactgattcgaccaaattagattattgacttgacaataatgaacaagatacccctttgaatttttgtcactacatctttttgtaactcatgaaaaatttcaggccaggcacagtggctcacacctgtaatcgccgtactttaggaggccgaggcgggattattacttgagctcaggatctccagaccagcctggacaacagaccaaaaccctgtctctacaaaaaatacaataattagctgggtgtggtggcgtgcacctctgattggtcccacctactcaggaggctggggtaggaggatcgcttgagcccaggggttcaaggttacagtgagctatgctcctgctgtgctgcgcaatccagcctgggcaaaagagtgagacctgtctcaaagaaaaaaaaatagaaatgtttgaacccataaagtagataatgaggaca

SEQ ID NO: 7743 - DNA, 344 bp, Homo sapiens
ataggggagcttctagaaaggaaggacttattgtcttagttacttgatccacttccttacctcctgttcatgcaactttgcttgttttgcttctactaaaatggttctaggtgctgtgtggacaggtgatacaaaagcctgactcacacggttgacattcattcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagacagggtctcactctgtcaccc

SEQ ID NO: 7744 - DNA, 605 bp, Homo sapiens
gtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattacccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagctt

SEQ ID NO: 7745 - DNA, 578 bp, Homo sapiens
gacttccggtcgcgccagccgcccgttgccagttctgcgcgtgtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctaccct

SEQ ID NO: 7746 - DNA, 522 bp, Homo sapiens
atactatgtttcgtctacagttggtaaatttttgtttttctttgtattaaatgttgaattgtattgtctggaggaaaagacagaggtctaaaaataaagaaggagtacagtttgggcatggtggttcacccctggagtcctagcactttgggggccaaggcaggcagattgcttgagcccaggagttctagatgagcctgggcaacatagtgagaccccatctctaaaaaaacagttttagggccaggcacagtggctcacacctgtaagcccagcactttgggaggccgaggcaggcagatcataagggcaagagattgagaccatcctggccaacatgatgaaaccctgtctctactaaaaatacaaaaaaattagctgggcgtggtggcacgcacctgtagtcccagctactggggaggctgaggcaggagaatcacttgaacctgggaggcagaggttgcagtgagccaagattgccccactgcactccagcctggtgacagagcaagactctgcctc

SEQ ID NO: 7747 - DNA, 587 bp, Homo sapiens
ataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgacgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaaggggttcttcacgattctcctggaacccagcctagcaaaatgagaggaaaggccctagggagatttatttctgttaaatagttaactctgctgagtat

SEQ ID NO: 7748 - DNA, 548 bp, Homo sapiens
gatgttctaaatgctgaacaacttcagaaactcctttacctgctggagtcaacggaggatcctgtaattattgaaatagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccggccatgacagaaggacttctccgtgcccaagtggattcatcattcctttccctttatgacagccacgtagc

SEQ ID NO: 7749 - DNA, 571 bp, Homo sapiens
atccatagaaacaactgggagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattgtgcgctgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatcta

SEQ ID NO: 7750 - DNA, 586 bp, Homo sapiens; identical to SEQ ID NO: 2421

SEQ ID NO: 7751 - DNA, 462 bp, Homo sapiens; identical to SEQ ID NO: 2422

SEQ ID NO: 7752 - DNA, 280 bp, Homo sapiens; identical to SEQ ID NO: 2423

SEQ ID NO: 7753 - DNA, 491 bp, Homo sapiens
acagaaggggcacttttgatttacttctgacttcacgagtcactttctgccaaagaaatctctccttttgcttctagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgac

SEQ ID NO: 7754 - DNA, 622 bp, Homo sapiens
gacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgac

SEQ ID NO: 7755 - DNA, 639 bp, Homo sapiens
acagaagggcgtgccaccgtcaaggcggcatgcagggctcagactaagcagttatgcacagatatgggttaagtacagaaaacttccaagccagtaggtaggagactgcgccaggtctcctgagcaactcctcctcacatctcccaaccattctcaggcccaccccccaaaaaaaatacaaaacacataatgaccctgataggggcctcttgaatcttgtcttctgcatttgtggcatttgttccattttgtcgcagcccatgccattatcagctgggaaaacttctgaaccccactcttgatgctaggttcccatgaggcaagtgctattagaaatagtttacagacaaggaaaataagaccccagaaaggttagtgatttctgtaaggtcatatgctattaagtaactaagctgggaggcaaagccaggtcagacttccaaacccatgctttcttccactttcatccttctaaatatctccttaaaaggaagctatgaatttggcaagtagtggacataaagagatgctcttgggatgcaatatgacgtaagatcatttgaaacaccaaaaacatggctaatattagtaacaaatcagccatgctcattctttggatcaggtaattttagtatctga

SEQ ID NO: 7756 - DNA, 488 bp, Homo sapiens
gacagaaggggtcatattgggggagttgcaggggggagagaagtagggagaagggttgtcctctttctttctaacctcccctcagtctatcctgtagtttaaattccatgaaggtgctggccatgtctattttgatcactgcattgtccttagcacctatcataacatctagacaatagcaggtattcaataaatgttggaatgtgtgaatgaataagaatttcaggctgaaaaatagagggaagttgttttctgcattcttgaaatcaatatcatattcctgtccggggaactgactaaactctgggtctttaggcagatatggaagtgtccttggcacagattcagttccatttgcaggtttgtgttcagtgtgtcctgtcatcatgactgtaccactacgccagtccctgggaagtggacctggcaccttccttcaccctcacatcaacaggaggacagttggagcctgagttcaagtttacctc

SEQ ID NO: 7757 - DNA, 631 bp, Homo sapiens
gtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgccaatgcttcgtattatagaaaattttttgaaacaaagttatgtcagatattttcagacctcaatgccacctatcgtacaattcaaggccatttacaatctgaaaactttaagcaacgggtaatgacttgcttc

SEQ ID NO: 7758 - DNA, 574 bp, Homo sapiens
acagaaggggaaacttcctagacgccgtacgtgccagatggtgttacctggagcttaaaaagctgcacgcaagtgttaaacttctggaggaatactgttggcgttcaaaagcattgctgtttcagttaagtagttccttaattacttacaatgtagtaaggctacattgaaggaagatataaatttcagtcaagactacgactgagcaaagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 7759 - DNA, 456 bp, Homo sapiens
acagaagggataacttaaaataacaagtttggaagataaaaatctgggagactatttgttttgtctaaattctgcttttactctggtcttttaacagttggcttttgataatgtattactgccttagtgtgttcctgtgtattgaaggaatacattgtctgacagaattgtggttgaaaatattacaagttctaaataataagagtaataaatatcatatcttgtttgctttgttgtcatagtcgcctgatctcatgcttccctgaattcggctggtgtcttgattacgatggaatcactaagcagagagttttgccatgtgtgatttattcgtttgtgcatagccacagcagagcatccatgcagcccgcagtggctctgtgttccagtgtggcaagtcaccaagacttgctaccttaaggccaggcgcagtggctcacgcctgtaatcccagca

SEQ ID NO: 7760 - DNA, 470 bp, Homo sapiens
acttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatc

SEQ ID NO: 7761 - DNA, 506 bp, Homo sapiens
gtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgc

SEQ ID NO: 7762 - DNA, 567 bp, Homo sapiens
acagaggggatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaggcatactagtacaagtggtaatttttgtacattacactaaattattagcatttgttttagcatt

SEQ ID NO: 7763 - DNA, 619 bp, Homo sapiens
acagaagggattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccgtactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcctgggtccctcatacagagaaatgcatcttgctgaacaagtgaccaataatcttaaagaacttgcacagcaagtaactccaggtgatatcgtaagcacgtatggagttcgaaaagcaatgaggatttccattccttcccccgtcatggaaaacaactttgtggatttgacaga

SEQ ID NO: 7764 - DNA, 508 bp, Homo sapiens
acagaagggggtcacatctatgtctcctagctcagtgttctttgtcattgtgtgtgtgtgtgtgtgtgtgtgtgtgtgattagaaagggcttcattcataccttttcccttggacctggaaaaaaaattttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatctaccagtttatttggtaaaaacacacagttatttggtatttgtcagaattcttcagtgcctgctattacagctattttccaattactaatttgaatatactcactcaaggcagcgcaag

SEQ ID NO: 7765 - DNA, 508 bp, Homo sapiens
acagcagggctattttatgccaggcattgggcaaggacccattggatatacagagatgactgacacagcatttagtttttcagaatctcatcggatagaggagacaatccaggctgagagcactatataaacaaaaggctggagtcctgaaaatgctttatgtgtttgcaggggatatagtttatgaaggaggggattaggcttaaaaagagctagacagtgaaaggtgaaagtagggaacagtggaaggtgatatggcctttaaactttgctgcttacaggtctttcaggttacagtttgaacttgatcctggaagcagcagagaaatcaatcactggctactcttaaaacagctgagtgacacaatcaaatgtgtacttcagaaattttccatgtggcaatgtggaggatgggctggattgccttgttattgggagacaaattagaaggctactgcaatagtcctagcaagagatgatgacaggctgggcacggtggctgacacct

SEQ ID NO: 7766 - DNA, 509 bp, Homo sapiens
gacagaagggcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatccacaagacagtaaagatgcactgcatttggcacaaacaaatggtatgtttttcagtacagttggatgtcatcctacaagatttggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaa

SEQ ID NO: 7767 - DNA, 647 bp, Homo sapiens
gtagagaaagattgttgtattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaaacagcctggcaacatggtgagacctggtctttacaaaatttttttggccggacgcagtggctcacacctgtaatccc

SEQ ID NO: 7768 - DNA, 371 bp, Homo sapiens
ggttatatgagagtgttttgccaagaatcggtcaaatgttttacattagggaaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactgtatagtatcatgaagttatatctttaaactcttaatttgtactatgtggtgtcttatgaaaaccttgatttgtttatacttagtgaatgaaacacttgggtttaaagttctttaactgatgtcacttctt

SEQ ID NO: 7769 - DNA, 52 bp, Homo sapiens
gtttaagtcctgtctgtctgtaaggcgtaaaatctgtccgtctgtaaggcgt

SEQ ID NO: 7770 - DNA, 150 bp, Homo sapiens
gatcatcctgtctggctgcagtgagagaccaacccctaacaagggctgggccacagcatggagtccagccctaccttcttcccttggcagctggagaaatctggtttcaatataactcatttaaaaatttatgccacagtccttataatt

SEQ ID NO: 7771 - DNA, 376 bp, Homo sapiens
ctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtga

SEQ ID NO: 7772 - DNA, 291 bp, Homo sapiens
gacagaagggatcatgaatctggtcatgccattattgcatattacacaaaagatgcaatgcctaccaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaa

SEQ ID NO: 7773 - DNA, 297 bp, Homo sapiens
gacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttt

SEQ ID NO: 7774 - DNA, 509 bp, Homo sapiens
atgtataggaattatcatgctttgacattttgattaacattttatagaatgccccacgttgttttttgcatggattgttataagtcaggaggaaggataagttgctccttaaaaacccttgtattatgccaagaccctaatttctgtcttaaaaaagtatgctttacaccttaaagcagcacttttattttgcacattgataatgctgtatgtatactttctttttttccattttattttatttaaaattttttttattttaatagcctttagggtacaattgcattttggttacaatgctgtatgtatacttccatgtagttttcttaatcagtaaaatgatctttcatgttaaagtctctatttgttagttttccctgactgtaattttctttctaccttgtataaatgataaaaatagactctaataaactgagtgtgctctggcatactagttattgacatgtttatattcacaaatataaactccaggctggctgtttttcttg

SEQ ID NO: 7775 - DNA, 515 bp, Homo sapiens
ggtgggctgaggcagcgcagccgctgccgcagggtgcgcgatgccttgaacctgggaaactgtgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtc

SEQ ID NO: 7776 - DNA, 449 bp, Homo sapiens
acagaagggatatacattttcctttctaattttacacacgctattatttatagagcacaaaacactcaaaactaaatcaggaagtatagtcggttagttgagataggatgtggtcttaagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaata

SEQ ID NO: 7777 - DNA, 649 bp, Homo sapiens
  misc_feature 536: n = A,T,C or G
ggtgacttggccaaggtaacacaacctgcctgaccctctggccatgcacacgtgtggagtttgttcccgggccctgtgcctgttcaaagaatggctggacgtcggtattgcccttggtttctgccctgaagtccagtcagtcagcagttctgcttattctgaccctctctgtgcagtattacccaacacacatgcatttcctccttgccttctcagtattgccatcgtgaaccagaattgtcacctccaatttaaacagtgaaggcctttgttaggaagaggggcagggtgcagagggggatggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgngtgctgtcatctgcctgactgaccttcctgtgtcctggtccgatggtgtctttgatcctatagctaagatcaagacactgaaaatctctagactcaagtctgtgcttttgctg

SEQ ID NO: 7778 - DNA, 499 bp, Homo sapiens
gacagaagggtcaggatccaattttagtgttggacaaagacaactggtgtgccttgccagggcaattctcatgaaaaatcatatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaaccgggcaaggcagaagccgctgccctcactgaaacagcaaaacaggtatacttcaaaagaaattatccacatattggccacactgaccacatggttacaaacacttccaatggacagccctcgaccttaactattttcgagacagcactgtgaatccaaccaaaatgtcaagtccgttcc

SEQ ID NO: 7779 - DNA, 498 bp, Homo sapiens
aatacagtatttcggattaactttagaaaactcaggtttaaggcttattgaccagaagacctctttcttatccaagtgtagggcaattcattgcaccttgaggtaggggaggagcaaaatcaggctggcaggggtccacggcagggcaagctctaggagctggtgagtctagaaggacggactagagagagctggcattggaatggacaatcgctagagggcgccggagcactagcagagtcaacctccgggacccataagcagggcttctaggataaggaatggagtttgacccaaccccaagatatgccctggggatattggttttctcaggtgcatctgactctccggcctggattgcctcgctgcggagaggggacaaaaggttttgccctgagcatctggtgatgtcttccagtgcctggttaggttgctccgcggctggacagtctgactactctcaaaactcctcgtgacaggcctttctgggtctgatcg

SEQ ID NO: 7780 - DNA, 488 bp, Homo sapiens
actgattgattctgcatccgcaaattgttttattaaaaacattctacatcatgtgtggggagataaggaggataaaatgaggagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttgctgtacatagttgcatgtactgcattatgcaaatgcattatattttatgtaacctgtccactgttggtaggcact

SEQ ID NO: 7781 - DNA, 115 bp, Homo sapiens
aacgtataaataaaatgacagtttgaacatacaaaacccaccccattcctccccacactcatcgcccttaccacgctactcctacctatctccccttttatactaataatcttac

SEQ ID NO: 7782 - DNA, 576 bp, Homo sapiens
gctggagagcagagcaccaagatcgttctggcaggaacagccagtgggaggttccagctgagcgctccccagaggtgagctgatccccagccacagcacacaggaccaggctgcgagaacagcatcatcagcatcatgctattacggtcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcact

SEQ ID NO: 7783 - DNA, 626 bp, Homo sapiens
aaggccccagctgtggggggcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcag

SEQ ID NO: 7784 - DNA, 528 bp, Homo sapiens
acagaaggggagttgtaacttgcctggtgcccaatagatgtcactctgttttcctagaaactttaaaatatccctcagtgctcctgttaattcatggtagtgccccaaggcactctggcacccagttttggaactgcagttttaaaagtcataaattgaatgaaaatgatagcaaaggtggaggtttttaaagagctatttataggtccctggacagcatcttttttcaattaggcagcaacctttttgccctatgtcgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgt

SEQ ID NO: 7785 - DNA, 528 bp, Homo sapiens
gctttctgccgccatcttggttccgcgttccctgcacaaaatgcccggcgaagccacagaaaccatccctgctacagagcaggagttgccgcagccccaggctgagacagggtctggaacagaatctgacagtgatgaatcagtaccagagcttgaagaacaggattccacccaggtaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtaca

SEQ ID NO: 7786 - DNA, 88 bp, Homo sapiens
agggatgtatgtcgctgtccaagagaaggctgtggaagaacctatacaactgtgtttaatctccaaagccatatcctctccttccatg

SEQ ID NO: 7787 - DNA, 69 bp, Homo sapiens
gattgtcttatcacctttattagataaatcatgaagtgtccctgtgaaattgaagtgaaactatctctg

SEQ ID NO: 7788 - DNA, 473 bp, Homo sapiens; identical to SEQ ID NO: 2436

SEQ ID NO: 7789 - DNA, 151 bp, Homo sapiens
attcatttctctaacagcagtaatattaataattttcatgatttgagaagccttcgcttcgaagcgaaaagtcctaatagtacaagaaccctccataaacctggagtgactatatggatgccccccaccctaccacacattcgaagaaccc

SEQ ID NO: 7790 - DNA, 547 bp, Homo sapiens
atcagatgaatggaaaaacttaggaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaaggggcaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttg

SEQ ID NO: 7791 - DNA, 488 bp, Homo sapiens
gggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtg

SEQ ID NO: 7792 - DNA, 577 bp, Homo sapiens
ggacccgccttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaatacaaccgtgatttcgagtccatatcacaagctacaagcag

SEQ ID NO: 7793 - DNA, 519 bp, Homo sapiens
atctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggttgaggtgggaagattctttgagcccaggagttcaaggctgcagtgaattctgatcgcaccactgaactccagcccgtatg

SEQ ID NO: 7794 - DNA, 451 bp, Homo sapiens
gaacagcccatggaagaatcatatgaagaggtggtgactgaggtcgtaagcaggagtggacatgtttggatttccaacagctaccctgctggactgtcatggaagatatgcccagaatgtagcgttcttcagtgagtgaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaagggtagtctaacgttacatgagagaatccacactggtcaaaggccttttgagtgcacccactgtggaaaaagcttcagggccaaaggcaatcttgttacacatcaacggatacaca

SEQ ID NO: 7795 - DNA, 607 bp, Homo sapiens
acagaagggggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgccttttttctgatccagaccctcggcacctgctacttaccaactggaaaattttatg

SEQ ID NO: 7796 - DNA, 69 bp, Homo sapiens
gatcatgaaaatgggtctgttgtgcgaagtgtctgccgctgtgcctgctgtgttatttttaactgatct

SEQ ID NO: 7797 - DNA, 503 bp, Homo sapiens
ggggatccacttccttacctcctgttcatgcaactttgcttgttttgcttctactaaaatggttctaggtgctgtgtggacaggtgatacaaaagcctgactcacacggttgacattcattcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagggtctcactctgtcacccaggctggagtgcagtggcgcagtcatggctccctgtaacctcaacctctcagactccagcaatcctcctgcgacagagacagagtctcactttgttgctcaggctggagtgcattggcacaatcttggctccctgcaacctccgcctcccaggtttgagcgattcttttgcctcagcctcctgagtatctgggatgacaggtgcc

SEQ ID NO: 7798 - DNA, 613 bp, Homo sapiens
acagaaggggggtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgtt

SEQ ID NO: 7799 - DNA, 698 bp, Homo sapiens
gaataagcttgcggccgcagtttttttttttttttttttttggctcaatgatatatttgccagttattttattttttctaaaaacaatagaaaaaaatcaactttaaaaagcaaaatgtacttaaataaaaaaaattagggtttatagtacctataatactaggtactatatactaggattgaaattctgtgtaactgctataaacgttttattaaagttatttacatttaatggcaatatttacagagaaacattgtgtaaatcttaaaattttttaaaaacaattcttaaatacaaatctgttaaagaaaaaaaaaagatggtaagcataaaaaagttcttttatgcccaaagtccaatttgaggcagtttacattatggctaaatctttcagtctcaagactcagccaaggttgtgaggttgcatttgatcatgcatttgaaacaagttcataggtgattgctcaggacatttctgttagaaggaatcgttttccttacttttccttacgcacaagagttccgtagctgttcaagtttgtgtttcaactgttctcgtcgtttccgcaacaagtcctcttcagaaatgagcttttgctcctctgcttggacggacaggatgtatgctgtggcttttttaaggataactaccttgggggccttttcattgttttccaactccgggatctggtcacgc

SEQ ID NO: 7800 - DNA, 655 bp, Homo sapiens
atggtgaaggccccaggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctg

SEQ ID NO: 7801 - DNA, 580 bp, Homo sapiens
tcctttaatgagtacttgttacagtaaaagaggtataaagtcctgttcccaagtccaaaccactttttaacttaaatcttgagtttttctgaattactcaatttgaagtaattctctttatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcag

SEQ ID NO: 7802 - DNA, 568 bp, Homo sapiens
aaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgagggctttgggaaccttggaggctgctgctccaggaactcgcggtcggccgggagccggggagcttcgttgctgggagcgggcggtattcgcggactccggcggccctggcgggtcgcggccgggatccgagccggggatgaccatgctgatggagctgatggggcaagagtgggaacggaggcacgtacactg

SEQ ID NO: 7803 - DNA, 547 bp, Homo sapiens
  misc_feature 522: n = A,T,C or G
ctgccaaaatatttttattctgttttcaaattgaacagcatatattgttagagtgagagtctgtaaattcagtcctcttctttgttggcattcagaagtctttgttgaaatctggatgagattctgaattcaggtgatgttgatttacataaattggatgtctctgggactttccattttgacagtcgctcttctacttcagtctcctgaagacatctctccaacagaagttacataaaaatactaatcttcaaggtgctttctaaaatattttcatcacgtcattaaaatcttctttcactaggcaatggttctgtctctatgggggctggcaggcagggcaaatgaattcctaccaataaggcgggcctagttggttcatgtcaattccaaagcaagaggatggttgaagaagggtattgaatgagtagataacaaatatttggagagagatttggaggaaccctggaagacaagagtaggctattggcaagggctacaagatggtagagacatccttgngctttgactctaattgaaaatacag

SEQ ID NO: 7804 - DNA, 662 bp, Homo sapiens
gcggccgcaccaatttttttttttttttttgtgagtttggacaaactttactgcaataaaacaaatgcttaatttaattcagaataagagataactcttcaataaaatatatcaaattgtacaagcaccctttcaaagggataaaggtataccggagggaggggagagatggacaggaaggtgaaataccagggagcttaatgggctgtttgacaaccccattttcaccaagtcaaaacatggctttaccttctgccccccaacatgtaaaaaagtatataaaattttctaataagtttaggacatacaacaggtacacacacagagaaagcatattttttttttctttctggatctactaattgttcaagaatatttagcatataggtaatggttacaagatactcattttttaagcagaaaattactaaacccccacccaaatcacctttgcaatctgtgaggatgaatgtacctagtatttctcagaaaccatcaattcctctcaacaggttttaacattttactctccaattatctgaaataaagttaccaacagccttgagaagaattaggaagtatttctaattttctacctcacctccaggcagtctcaggattcttctcatcccaggtattggtcttacaaaaatattcttaaa

SEQ ID NO: 7805 - DNA, 423 bp, Homo sapiens
catgttcccgtatgctttattggaatgctgtcaggtccgcgccttccacctgggccctcacacacagcaaggagaggccccagcaccggtcccaggcccacctgcccgcacctgcagaagggaaaggccatcaccctccgtggacggggtctcggccaccacatccaccttctgaaggtggcccagacacctccacgctgctgactgcacttcccatcaaaagggactccctggggcagagtgggccgtccccctacccccgaggaaggcaccctcctgggcggggacagaccttggctccatgctgccaagtcaaggtgctggcgtggaaacaggcacatgtggaacaccacatcccactgtccaaggtggagtccgtgtctggtgaacctggtgaacttggtggtgggacggtgctgatgc

SEQ ID NO: 7806 - DNA, 500 bp, Homo sapiens
aactggtgaagtttttattaaatccacagaagtaaaaaccatatcgtgaggaactgggggaaggggccaccagggagtgggagtcaggccaccaggggagtggggatggggtgacaggacagagaacagagccaggctgggctggccatgggggctccagcctcaggggccatcaccagggccaccagacagctcctgggaactcaggccagcaccaggcaggctcatcggcgggggctccaccagcacagcagagaacttggtgtcaccgaaggcctcgttcatgcgcgtctcgaagaagcgctgcaggccgatgatggactgcacgtctgccttgtcctcagttaacttgttgaattgcttgaacatgcggcccacatcctgggcaaactcctgtggggagctgtagggaggtgacacttctcctggaggcgggcacggatacaggtcagattcagagtgccaccgggctggtacaaggaaaaagtggagtcggtacc

SEQ ID NO: 7807 - DNA, 180 bp, Homo sapiens
caacttgcatattctggggaagtgagaggtaatatacagtgtaaatgaatgaacagttagcatgttggtaatacaaaatatgtttgcttatttatggtaagtcatatgattccctagaggtaaacctgtctaaattgtttacgtgtttataatctaagtgattattttaaaaatggatac

SEQ ID NO: 7808 - DNA, 586 bp, Homo sapiens
gacagagggggttttcccgaacgcccgcagcagggtcagaagggaggtggccggtctccgtcgtgacctctgacggtttctgagcgttggcctttggcacgcgctacccccttttgctttggttctgccatgccgatgtaccaggaagagtctaacctgtctcggcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgc

SEQ ID NO: 7809 - DNA, 505 bp, Homo sapiens
ttgtttatcctagtgtttcgtacaagtgaatgttatatcatgtatatctctggggggaagaaaggccgagacctgtcatgggagactgtgcctttgctagccagtctgtaaattgaataatcttgaaacatttaggtaggcacatttggggtgacttcaaagtgctttatgaagtcttctctcctcacacatctccagagactaccatacctgaaatttcatgattgtttaagataagaattgcttttttgatagatatttcagaagtaactgatatttaaaacataattaactgactaatttaaatttttttccttttgggtaatgttgaatctaggaaaaaaatcctgttattcaggagcctttttgagagttaactttcatgcttctttttaaatccatatcccatgcctctttgaaattgtcactcggaggttgggcgcggtggctcacacttgtaattccagcactttgggaggccgggtgggtggatctcctgcggtca

SEQ ID NO: 7810 - DNA, 610 bp, Homo sapiens
gacagaagggaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgat

SEQ ID NO: 7811 - DNA, 481 bp, Homo sapiens
aacgaggctgtctctcttcccttctcttgtttagctatgagattgacacatcatggggaaagcatttagaatgtacccagtgctttggggtgcttggtgccacccagcactgtgagcacaggttcttctaccttggggccacacccagttacctgtatctcactgcacagcagtggctgttggggaccaggcccacccctccatgtcccacctcctgcaactgcagcctgagccttcccatcagcctggggtggtgcagacccatgtgccattgtggatccttcaagttacctgtgtggcagagaggacgtgtgagtgccgtccaaacccaaacactgagagggtccttcccattgcccccacggaagtaaggtgccccagtgctaattccacttatacttgctggtggcaaggacacttctcctccttattaaagtgggggattggctgggtgaggtggctcacgcctgttatcccagca

SEQ ID NO: 7812 - DNA, 445 bp, Homo sapiens
acagcaggggtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcacttttttttttt

SEQ ID NO: 7813 - DNA, 384 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggccgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggc

SEQ ID NO: 7814 - DNA, 453 bp, Homo sapiens
ataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttc

SEQ ID NO: 7815 - DNA, 517 bp, Homo sapiens; identical to SEQ ID NO: 2447

SEQ ID NO: 7816 - DNA, 501 bp, Homo sapiens
agggagtatataatgaaattaagtaaatgaggaattgcctaaaactaagggagtttcacctccatgtaggtagaagaatgtgaaatggtctgtgtccagaagccagatcagaaatggtccatagcaaggtggggagggcagcgggtacccacctggcagtgtagggggttggattcagcttcatcttcctgaccccttgtcaagtggacgagctccagccaaacaaaggaagtgtgttggagtggccaccagcacagaagtgtacctttctgggtaatgtgtcacccagtcccctggccatgtgagaggacaggcacagttgccacacagtactaatagttggtctcttctttaagggtcaaaaaaaaggaggtggagcacttttaagaaagtgttaaggttccatgaagatgttatggtggcgtgctggcaggtgcatatcaaccctgccctgaggccctcagcagccttcggtctccccaaagcaatatggctccttat

SEQ ID NO: 7817 - DNA, 334 bp, Homo sapiens
gacttggttcatcttcagaaaggggaagccaacccctcctgtgctgccagtcactgtaacccactagaactaataattaccaatcccctagatccccattggaaaaagggagaatgtgtaaccctggggatcgaagggacagggttaaacccccaagttgccattttagttcaaggggaggtccacaagcactctcccaaaccagtgtttcaaaccttttatgaggagctaaatctgccagcaccagaacttctgaaaaagataaaaaatttgtttctccaattagcagaaaatgtagctcattcccttaatgttacttcttgttatatatgcg

SEQ ID NO: 7818 - DNA, 464 bp, Homo sapiens; identical to SEQ ID NO: 2449

SEQ ID NO: 7819 - DNA, 391 bp, Homo sapiens
atggccaaatcgtattccatggtgtatgtgggagatatatatatatatagatatagatatatatctcacattttctttattcactcattagttgatgggcatttaggctggttctatatttttgcaattgcaaattgtgctgctatgaacatgcatgtacaagtgtctttttcatataatgacttctttacctctgggtagatacccagtagtgattgctggatcaaacggtagatctacttttagtgctttaaggagtctccatactgttttctgtagtggttatagtagtttacattcccaccagcactgtaaaagtgttcccttttcaccacatccacaccaacatctattattttttaatttttaaattatggccattcttgcaaga

SEQ ID NO: 7820 - DNA, 75 bp, Homo sapiens
gacagaaggggaggcattgaagcagccagcgcaagggcttctgctgagggggcaggcggagcttgaggaaaccgc

SEQ ID NO: 7821 - DNA, 294 bp, Homo sapiens
acaggaaactacagtatttgagttgcttttctaagtaagctaaagcctttgcttgtcttactgtttaacctgacttgctatgatccctgatgtagagctttaagtgaaaacttaatggctaactagtgtggaggatgaccatgtacctgaaaatttcttcaccaaaaataaccatatgggccaggcacggtggctcacacctatcattccaacactttgggaggtcaaggtgggaagattgcttgagcctaggaatttgcgaccagcctgggaaacatggcaaaatcccatctc

SEQ ID NO: 7822 - DNA, 249 bp, Homo sapiens
gagaccagcctgaccaacatggtatcgctcctaaaatacaaaaattagctgggcctggtggcgcatgcctgtaatcccagctactcaggagacttgaggcaggagaatcgcttgaacctgggaggtagaggttgctgtgagccgagatcgcaccaccgcactctagcctgggtgacagagcgagactccatctcaaaaagaaagaaagaaagaaaatgccagacatttattgaggggctggaatgatat

SEQ ID NO: 7823 - DNA, 433 bp, Homo sapiens
gcctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacgaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctg

SEQ ID NO: 7824 - DNA, 382 bp, Homo sapiens
cccaaagtgctgggattacaggcatgagccactgcacccagcccaacaggcagattctgttagatcagtcatatcatctgcataagtgaagagagcattcattacacactgagctactttggcaattgtttgttacaaaccataactcattagatatccctaagctcatcatcggaactgaggcaatatcctaccatgtcacttgattgtccatttggttctgagtcaggcttaacaatcatccacagaacagactagtccaatttctatgggtcccagaagagctgtcaataacaacagtgtcaagtcagatcctgtttgactgtaaacaacagaaaactcagctgatacacatgtgtctcgcccattaaggaatttagat

SEQ ID NO: 7825 - DNA, 613 bp, Homo sapiens
gaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctg

SEQ ID NO: 7826 - DNA, 531 bp, Homo sapiens
acagaagggatccatttttcatgttatggaacatcggttttcttttcaccaaaatgattatagagcttgataggactttacaaagattctacagaacagtgttttgtaaatttttgttattattttaagcttttattttgaaataattatagattcacaagaagttacaaggctagaacagggttcccctggtcgacctggtttcccccaatggttacttcttttataactttagtacaatatcgtaaccagaaaattgatattggtatgatgtgtgtgtaaaattctgtgtcaatttatcacacgtgtagatttatgtaaccaccttattcgaggtacagtactatttcatcaccacaaagctcttcatgttgctacccctttattgccacacccacctccttaaatgcccccacacccccaatccataaccactggctaccactaatttgttctctgtctctaccattttgtcatctcaagaatgtgccgtatacccagacttcaccactgtacaatatatgcacgtaa

SEQ ID NO: 7827 - DNA, 282 bp, Homo sapiens
ggaagcagggtacttgctgctttgcaagtgtgtccacatctaattaatagtacagttcttactcttggtgtgtccggtgatattaaaaattaatgtgccttatttagataagtaacataaaaatcacaaaatgtatgccttagatttatatgtatttataactagtctatttcctgaaaacagttgagacaccttgtaaaagttaccggtacgatagggccattccaacaaagctgtaaagtggtgataacacagtcataaagaagaggagatagctctggg

SEQ ID NO: 7828 - DNA, 551 bp, Homo sapiens
  misc_feature 356: n = A,T,C or G
tacacaaatgcaaacctttgcaaacacattattatgcttttgcacacacacacctgtacacacacaccggcttgtttatacacagggagtgtatggttcctgtaagcactaagttagctgttttcatttaatgaggtgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacgggggtatggcaaagtagacaaatgttttttgttcatttggagcttagagtccaggaggaatacnttagataatgacacaatcaaatataaattgcaagatgtcacaggtgtgatgaagggagagttggagataccatgagtttgtgtaacaggaggacacagcattattctagtgctgtactgttccgtacggcagccactacccacatgtaactttttaagatttaaatttaaaataattaacattcaaaacgcagct

SEQ ID NO: 7829 - DNA, 314 bp, Homo sapiens
gggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcact

SEQ ID NO: 7830 - DNA, 416 bp, Homo sapiens; identical to SEQ ID NO: 2457

SEQ ID NO: 7831 - DNA, 472 bp, Homo sapiens
agcccccaacaccctccctacacccacggacattgggaaatggcatagcggcatttttttattgttgaaatctcttgtgggtattcagtaggctggcaccaggaatgctgggtgccagatagtcccacataatgaggaattgtctgcagaaatgccatagcactcattgagaaacaccgtggtgtgaaattcatgttgtaggtttgttaagccagtattttctaagttcagtgccaaaaagcaagctgtatgctaaggattgtgtatgaatagacaggaagagacttctttgttccacaggacattttcagaaaattcttacttttgtttggagtatcagaaattgcttacagagcagggccttagctcatacctgtgatctcagcactttgggagtctgaggcgggaggatcacttgagcccatgggttcgagaccagcctgggcaaaattccgaggccctgcctctacag

SEQ ID NO: 7832 - DNA, 175 bp, Homo sapiens
gacataagggggaaatgggctggggccctcttgctcaccctagacttggaaaaaccagtttctcttttattgtctgttactaatctctattctaaaaattcagctcaattctcaaccatactccaaactctctcttttccagctacctttactccctctccttcaattccacttt

SEQ ID NO: 7833 - DNA, 418 bp, Homo sapiens
ataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatac

SEQ ID NO: 7834 - DNA, 490 bp, Homo sapiens
gacagaaggggtctgagttttaaaaatctcttcccattttcaaagatttttcaaatggatgtaggagaggaccaaggaggtaggctatagctgtagaacaacacagtcctattttcagaaacgaacagacacacgttttaggtcaggcacagcccatgtatccaggtgcatcaaactggggatgctaagttcaaaagtgcgtctgttttgaagatttcatctgaaaataatgtgtacactttcattactaccagtttgcattcaaaatagtttttgagactctttaaactcttctggatactttaattttccctttggaatagtgtgtaaacacagtccggatgaactttactactgatacctcacttgaggttgacaggagtggccagcagttagtgcctatggtcatgtaatacactaagtcaatacctgtggagtgaaatccggtctctataaaaaatacaaaaaaaatggctggacgcagtggctc

SEQ ID NO: 7835 - DNA, 565 bp, Homo sapiens; identical to SEQ ID NO: 2462

SEQ ID NO: 7836 - DNA, 91 bp, Homo sapiens
gacagaaggggaaaaacactgctttacatagactgcctttcccaaatcttttcttggccagtttcttgtcattcgtgtcttatttaaaaga

SEQ ID NO: 7837 - DNA, 457 bp, Homo sapiens
  misc_feature 356: n = A,T,C or G
agggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatttataacaaaatcaataccaagagccttcaaagattgaattctgctcatcaaataggttcacatgctgaaatcctaatgccttccttctccctttagaaattaaattctgaatgtgcccaaacctggataatgattaaagatagatgagttcttggctgggcaccgtggctcatgcctgtaatcccancactgtgggaggctgaggtggaggcatcacctgaggtcaggagttcgagatcagcctggccaacatggtgaaactctgtctctacaaaaaaaaaaaaaaaa

SEQ ID NO: 7838 - DNA, 525 bp, Homo sapiens
gacagagggggaaccaccgtggcatatgccgtctgtcattgactgaaacgtcattatgcagggcatgactgtacttacaaaattagatggcacttcttaggaacattcctttgctatgagttgttttaaaacttaatgtacttaaattttttttattataaaaaatttccaacataaacaaagagggagaatgtatgtatattaagggtctcactctgttgcccaggctgtagtgccgtggtgcgatcatggctcactgcagcctcgacctcctggactcaagtgattgagggagaatattataatgaatgactttatattcctcacctgggttaggatgaaatgctaaggtcacagctaagcaaaagccactttaaaggaaaggaatgttgctgccacgagtggcgttcctgcagaaaggtcattaagtcagaattactactctgtgttctggagggaaaataccatgacactaagaatttagctgtgggtcagggaggcattttatgtggtgtgaatcaaact

SEQ ID NO: 7839 - DNA, 523 bp, Homo sapiens
gttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttga

SEQ ID NO: 7840 - DNA, 257 bp, Homo sapiens
actgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgtaaatttgttcattcctggtagtctattttctataaaaatgtatttttgcataacatttttaaaaactggtgtaccttcatctatgacgtg

SEQ ID NO: 7841 - DNA, 517 bp, Homo sapiens
gatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagt

SEQ ID NO: 7842 - DNA, 432 bp, Homo sapiens
gggaaggattcagtggtaagaggcaacgtagtaaagagtatcagctatcaactttgagtcagagacttgggttcaaatgctgactctgccattcattggttacacgtcctcccgctagaaattctgcaaggaatttgctctctcagtgttgcatttcttcacatttacatggagataataattactgtgaatattgaataagtggccttcaataaattatttgtttatttattttcagagacagggtcttgctctgtggcctaggctggagtgaagtggcaccattatagctccctgcagcctcgaattcttggcctcaagttatcctcccacctcggcctcccaaagtgctgggattacaggcatgagctactgcaccctgtcacaataaattgtttaaatagttgcttaattattccttaaattattcct

SEQ ID NO: 7843 - DNA, 578 bp, Homo sapiens
acagaaggggggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatgtaggcaattatggtcactggaatagtttgtcttgttttcaaatattattggtgcatgtacaacagcatccaacatatctgtcttgttcctagatatatagctctgattttaggccttttgtg

SEQ ID NO: 7844 - DNA, 556 bp, Homo sapiens
aatataaaccagaaggaagttattgccaccaatctctacctctatggttctaagatcacaaacaccagccctcgatgatcctatggctttagttgccacccatggtggacattgtagttgtctacccaaaattcatttcactctctgctactgtgtagtagccatgtggtttggatggaactgaccagagatggggcctgattaggctaagccagtggttctcaatcctggcccattgggattacctaaggagcttaaaacaaaacagaaaaaaatcagccaaccaaatcctcctccctgaaatgcctgggagtggggcctggatgttggcactttctagatacttcccaggtgagtctaatgggcagccagtgttgagaaccactggtctaccatcttccctgccactggcattggttcaggaaattcacacctatgccagttagcttttgccattccccaagctacaggaactggttgtcgtggttacaatcaacataatcagggtagctcaggactttcgttttatagacatagaaaagtactcagtctcctc

SEQ ID NO: 7845 - DNA, 515 bp, Homo sapiens
acagaaggggagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacgggaaagaagagtgggaaattgaaggcctcctataaacgggattgttttagtgttggcagtaatgttgatatagatttttctggaccaaccatctatggct

SEQ ID NO: 7846 - DNA, 472 bp, Homo sapiens
gacagaagggggagaagccacttcccctctctggatctctgtttcactacctatgaggagattaaactagactgtctataagagtccttctctgagttgttctctgatcttagattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcagctacatgtttattgaatgatgaaacagctgaacacattcctgcacagaaaacacacattgtctaggtgacaaagagtaatgtggacacatcagggccaccttctgacctttgctagtttttttgttagtttgttttgtttttgtttctttgtattttttgtttgtttttgtgtctgtttttgagacagggtctcattctgtcct

SEQ ID NO: 7847 - DNA, 158 bp, Homo sapiens
gaaaatgattgaaagttaaactgataatttcttgaattggcaacgtaggatgtcaaaactgattttataagtcagtatttgtacttttcatatttcttaattccttcttagaatgaaacttgtcataaatatattttatgttcttttttttttttttt

SEQ ID NO: 7848 - DNA, 488 bp, Homo sapiens
gacgacagaagggtacggctgcgagaagacgacagaagggtacggctgcgagaagacgacagaagggtacggctgcgagaagacgacagaagggtacggctgcgagaagacgacagaaggggggttctgcatccatggattcaaccaattgcagatcaaaattatttgggggggaaaaaaaaacaataggccaggcgtagtgactcacgcctgtaatcccagcactttgggaggccgaggcaggtggatcacttgagccccggagttcaagaccagcctgggcaaaatggtgaaatcccatctcttcaaaaaatacaaaaagtagccggatttggtggcccgtgcctgtagtcccagctactcgggatactaaggtgggaggatcgctttaccccaggaggcagaggttgcagtgagctgagattgtgccactgtactccagcttggtcaacagcatgagagcctgtcccaaaaaaaaaaaaaaaaaa

SEQ ID NO: 7849 - DNA, 590 bp, Homo sapiens
gacagaggggtgtcttggattggctcacagcctgtctcgatatagattgaagtttagcgctgataaagtagacacaatgattgttcaggcaatttccctgttagatgacttggataaagaactaaacaactacattatgcgatgtagagaatggtatggctggcatttccctgaattaggaaagattatttcagataatttaacatactgcaagtgtttacagaaagttggcgataggaagaactatgcctctgccaagctttctgagttgctgccagaagaagttgaagcagaagtgaaagcagctgcagagatatccatgggaacagaggtttcagaacaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatcta

SEQ ID NO: 7850 - DNA, 561 bp, Homo sapiens
cagcatggagtgtttctgctgatttctgtccctgcatctcccctagccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaataccatgcttggtcttctctgc

SEQ ID NO: 7851 - DNA, 414 bp, Homo sapiens
acagaagggatttcttttcaattcagtaagacaagtaaggagaaaaacacttttcaagtcttttatattacactgtatatttatcactgactttactcttgatttcttcctgtatattcaagttattgtctggtgacctttccttgctccagtatatataataacttcattgcttccttgctcctttatgctgttattgtcatatatattatatatgtttatgctgtgagcccatcagctaagtcagcttagcaaggtctcaagatacaaagtcaatgaataaatcaggctgggtgtggtggctcacgcctgcagtcccagcactttgggaggccgggataggtggatcacttggggccaggagtttgagagcagcctggcccacatggcaggactccatctttacaaaaatac

SEQ ID NO: 7852 - DNA, 409 bp, Homo sapiens; identical to SEQ ID NO: 2470

SEQ ID NO: 7853 - DNA, 492 bp, Homo sapiens; identical to SEQ ID NO: 2471

SEQ ID NO: 7854 - DNA, 542 bp, Homo sapiens
aagggtggatcaggcctcaggcccaagttgatccactgatcaaatcccttgaagatcctttctgtccctagtctctgctttgcgctgcttgttggcattattcttccaggctaagtgttcccacaaggctggaacccagggaagctcaaggatttatattctatcctagagaggaaaataaactctttcccatccactgcacatagaaaaatctcaaggaaggatcctgattggccaggcttgggtcatatgcccattcctggaccaatcactgtggccagaggagtggggtaccaggattggccaagcttgagtcacgtgtctacctctatggtcagagggtggagctgttttaagaaaaggatgagaaggccggcagtggtggctcatgcctgtaatcccagtactttgggaggccaaggcaggtggatcatgacgtcaggggtttgagaccagcctggccaacatggtgaaaccccgtctctactaaaaatacaaaaattagccgggcgtggtggcacatgcctgtagtcccagctact

SEQ ID NO: 7855 - DNA, 502 bp, Homo sapiens
gtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataattt

SEQ ID NO: 7856 - DNA, 569 bp, Homo sapiens
acagaaggggtgctcggtcggccacggctctgctgggctcctggcgccgcctcctcccagcccgccgcgggctgcgcgcttctgtgggtgggggaaggcaggactgacgcagactcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaac

SEQ ID NO: 7857 - DNA, 69 bp, Homo sapiens
gatgccctaatgatgctgacttgtcatggttgcagcatttgaacttttggtgttaaaaaaaaaaaacct

SEQ ID NO: 7858 - DNA, 534 bp, Homo sapiens
gcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgag

SEQ ID NO: 7859 - DNA, 577 bp, Homo sapiens
atggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactcaggaaagtctgcttgttctctgtggaggagatgattaaaataaaaatccca

SEQ ID NO: 7860 - DNA, 64 bp, Homo sapiens
aagatggcacaggctctgccgtgtccttggagtgaaagactctttttaccagaggtttcctctt

SEQ ID NO: 7861 - DNA, 568 bp, Homo sapiens
gttacaggcatgagccaccacgcctagcccctgttgtgaacttctaaaaaactatttggaagtgcaaaaccagcaaatcttaggaccaagaaaaggtaaagcagccatgttttaaagtaattaaaaatataataaattgataatataatacataatgatcaatttcagaagctctgcagttctcctctcagatgctacaacctggagccttgagagctctcatttctaaagataacgcatacataagacccagaaatggtacatcaggaaacctctattgttatcagtggcactattattatagaggctaagttgtccacagaaggtaaatgatgggaaggaaagactaaatgactgaggggtagaattacaaaaggacattatggcccaagtattgtacattatgcttacaaatatctgggaatatacatttcttctcagtatttctctgtattattgcatttctttcagcattatataaatgcctgcactgccaactctgctcatgttataaaaacaaataaacagcttctcataaatgtaaaaatgaaagaagctaaggaataca

SEQ ID NO: 7862 - DNA, 629 bp, Homo sapiens
acagaagggaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatacaccaggtgcacgggggacaatgagaaggtgaaggctcacattctgctgacggctggaatcatcttcctcatcacgggcatggtggtgctcatccctgtgagctgggttgccaatgccatcatcagagatttctataactcaatagtgaatgttgcccaaaaacgtgagcttggagaagct

SEQ ID NO: 7863 - DNA, 624 bp, Homo sapiens
  misc_feature 572: n = A,T,C or G
gagctatagctaggcctgctcctctttgcacagctcaagatgacgtgtacaattactttggcacctcaccagctctttcagaccttttccatgcatgatgggaagacaggtccattctctgagagtccctcactccctccccctcccaaattcccccttacctggatgaaatcctgatgtaaatggaccttgcctgcaaatagaactgaagggacctgttacgtcatcaggcctggcagagctcattggcagagaagttaagagttttattttagacccagagaccaggctgtgcagatccagctagaacaggtctcttctggctcagcctcagctgctggccctcctgctgtggttactggggctccaaaggatggaatgtcagggggatcatgctgcacagtgagcaggacaacctgacggccagaccaaatgcactccaaaggaaatctcaggctagggtaatacagccaaggtgctgcctctacaatcatgggaggtttcaaccttctgggagaaaagccctaatgcagcacatgatggtatagatttgatccaggaaggcagagtanacaaactatttaaagacatgagtcttggctgggcacggtggctcacgcctgt

SEQ ID NO: 7864 - DNA, 458 bp, Homo sapiens; identical to SEQ ID NO: 2475

SEQ ID NO: 7865 - DNA, 562 bp, Homo sapiens; identical to SEQ ID NO: 2476
  misc_feature 413: n = A,T,C or G

SEQ ID NO: 7866 - DNA, 525 bp, Homo sapiens
gtggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactagcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgccca

SEQ ID NO: 7867 - DNA, 494 bp, Homo sapiens
ctcctaacctcgctctcgcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggaca

SEQ ID NO: 7868 - DNA, 62 bp, Homo sapiens
ggagaacctgattcggcttggattgagtcaggttccaccccagtccagtcagttgtggactg

SEQ ID NO: 7869 - DNA, 302 bp, Homo sapiens; identical to SEQ ID NO: 2479

SEQ ID NO: 7870 - DNA, 627 bp, Homo sapiens
acagagggggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatg

SEQ ID NO: 7871 - DNA, 569 bp, Homo sapiens
gacagaaggggtgacacattaataatcaaattgctaaaaccctgaatctgcttattcttcagcttcacctctgcactaaccccttacccttatggtacgtcaggattttaactagtactgctttgttgactttgtgaaatggtgccactcaaaagcaacttcctaacttgaggaataactcctttgtagtttactttctgtactggttggtgccttgtattgggatacagctatattcttagctcaaatgtcctctttttgagagcaaagtagttatccaatggtgaggcgagaccctgacgctcatagaggccattccttcctgggtgtcggaccagggctctgtgtcagggaaaaccttctgggtggactttgtaagaatccagtttccaaggttagattcacatccttaatcttgcagagactagaatttcacagctcgctttggaacatattccaattcaaccagttaaaatcagaggaccaagtcgtgggggaggggggcggtgttgaggagaagtatttttaaagatctggcaacttttcaggattatttgtggagaactcta

SEQ ID NO: 7872 - DNA, 458 bp, Homo sapiens
gacagaagggatacaaaagtcatctgggcatggtggctggtgcatgcctatagtttcagctacttgggaggctgaggcaagaggatcacttgagccagggaggtcgagaccagcctgggcaacatagggagaccctgtctctacaaaaaaaaataaaaaattagccagtatagtggcatagacctgtagacccagttattcaggaggctgaagtgggaggatcacttaagcccgggaggttgaggctgcagtgagctatgtttgcaccactgcactacagcctgggcaacagagtaaaaccctgtctcaaaaaaaaaaaggaaggaaggaaggaaccttttttggggtttctacttactaatttggagcctcaggcaaatcacttcagggtctctgagtctttatttcctcctgcataaaaggttaacagcagtattactgacctgtaaaaattatcg

SEQ ID NO: 7873 - DNA, 571 bp, Homo sapiens
acagaagggattccttcaaggcccgttcctcttattaaaaaatgataataatctttggaaattggtcattgggatatttgcattccatcttatttttgatatttttctgtctaatttctaattgtttatattgacaggttacatgctcatttagataatttggataatgaagaaaaatgaagtttaaaaatcaactcaaatcccaccatctggaaaaaaaactaacaaacatgaattgagcttcatttcagagatgacagtgtctcactttttttacctctctctttctgtttctttggtttcatcgaatttggagcctctcttgagctttgatgtcttttaagatgcccactctgtttgctcttatagatcattcgttctttctatttgagtccctaaagtattattgggatttctgaagcttaaccaaaatatgtctcagtattatgcatttcctgaaacatggagtgttctttcagtctgcgtatcagtttgttctagctcagggaattttttttttaaaaaagattaagtttggctgggagcagtggctcactcctgtaatcccggc

SEQ ID NO: 7874 - DNA, 600 bp, Homo sapiens
gacagaaggaggaattctcttccacagcacctgaaagatttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacgagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagtaccttagaggtcgaggcaggcggatcacttgaggtcaggagttc

SEQ ID NO: 7875 - DNA, 88 bp, Homo sapiens
gcgaacttccctcatttctctctgcaatctgcaaataactcctccattgaaataactcctccccaccccaacaacaacattcccagca

SEQ ID NO: 7876 - DNA, 528 bp, Homo sapiens
atacgtattgtgcctaggatcctaactgcgcaccttctttaattcatttataaaatttttaggctaatacgagctttgaatgcaaacacattctcttcagtgatatatctgtatagtctaattaaaaataaaaatatataaagaccttaataaatactaataatggaggtcaaagggcacatagtgaagtgcagttgagaaatgacgtgacctgtgtatttgtcttattcctgctatatcgcataaacaggagaatgaattgaaaattgtaattaagatttattccattttgttaagattaaaaatgagcagtcaaataattctttctctgagagaagagtgtatggtaggtccattgagggtgtctgttgtatcttaaaatctattcgaaatgtttgggtgaattattgtctaaattgacagatgattgcttttgagctaacaaaatatttctgttagcatagctaaagaatatatgttaaggaatatatgctctttgtaagttttgattgagtagataagatgata

SEQ ID NO: 7877 - DNA, 152 bp, Homo sapiens
gctgcgagaatacgacagaagggtacggctgcgataagactacagaagggtacggctgcgagaatacgacataaggggaaaaagcctgggccggacgcggtggctcacgcctgtaatcccaacactttgggaggccgaggtgggtggatcac

SEQ ID NO: 7878 - DNA, 301 bp, Homo sapiens
agcaggagtcagcagcctctggcctgtggaccaattctgaccctatgcctgtttttgtacagcctgcaagctaataatgactttcacattttaaaatgattatttttaaaaagaagaagatgtaactgggcattgaaggtccacaaagcctaaaatatttactatctggccctatacaggaaaagtttgctaacccatgatctatcttcataaggttccccataaccactgaaagtctcttctcagtattatcccactttattggatcctatagcctcttgtcttaagaattcccatactt

SEQ ID NO: 7879 - DNA, 311 bp, Homo sapiens
ccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacag

SEQ ID NO: 7880 - DNA, 92 bp, Homo sapiens
ggctcggtcacgaggtggaagaagtagaggacgatactctgaccgttttagtagtcgcagacctcgaaatgatagacgaaatgctccacccg

SEQ ID NO: 7881 - DNA, 56 bp, Homo sapiens
atcttttcagttttttgttttttgtttttttttgtttttttttggttttttttttt

SEQ ID NO: 7882 - DNA, 464 bp, Homo sapiens
attaaatatttgaccataaaatcaaactatcggcacatcgttgtataacatttagaaactatagctcattttaaagctaggaaccctttaaatttcaaggcaccattattgggggtgtgaatttagagaaatatactggaaagcagcctcttcacacatttcttcccagccatgaggtaaagaccttctactatcataagagcaaactgaaggccttcctcaaaggggttggccctgaggctattcattcccttgcatcaagtctcttgaatttcttttcttctttattgtcatcatattattctaaggagccctcttttacttctactcctctctttaaggaggactgggtcaccaccaagaagacttttgatggtgggataacatgattctgttgtctgagtttgtggcgttgctcaaggatggtaaaggttggccaggtgtggtggcttacacctgtaatt

SEQ ID NO: 7883 - DNA, 509 bp, Homo sapiens
gacagaggggggagaaatcacagatgccctgaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccgtgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattcc

SEQ ID NO: 7884 - DNA, 612 bp, Homo sapiens
gaaaataaatgttatttgttgatcatttctataatccagagctttagaggaagacacataggtgggtttatgtttcacctcatttggaacaaaagaggacagaagcaggccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaataaattgtgatcaataatagtacctttgattatacatttattattgtgtctctctctgatgtactgggga

SEQ ID NO: 7885 - DNA, 519 bp, Homo sapiens
gctcctcataccctttacctagactcacaaatttttaatatttagtttcctttttagacccaggcttgagtgcagtgatgcaatcatggctcgctgtagccacaacctcccgagttcaggcggccctcccaagtggctgagaccacaggtacacaccaccatgccggctagtttttgtattttttgtagagatgaggttactccatgttgcccaggctgctcttgaactcctgggctcaagcgatccactcactttggcctcctaaagtactaggactgcaggcatgagccagcgcactcaacctaactccattttaaaaatcattcactttgtctctttatgtatatataaatataaaaattatttgtaaataaataaatttttaactatttgagagtaaattgtaaacaatcaccccaagtgtgtatttcctagaataaggatattcttctatgtaactccagaataatattaaaattaggacattactgggtgtggtggctcacgcctttaatccc

SEQ ID NO: 7886 - DNA, 521 bp, Homo sapiens
ggggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttag

SEQ ID NO: 7887 - DNA, 500 bp, Homo sapiens
gaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatgtattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatc

SEQ ID NO: 7888 - DNA, 388 bp, Homo sapiens
ggcagagctagctgaggttttattttggaccaaaaaaaaaaagcaattgaattgttttgtagctggaggcatgggcaaggggggtccccaggtagtaaactccccaggtgggctgagggctagggctgagcctcaggtgggtctcctgttcccagtgctaccctgcatagcggcctccttcccaggctctggggcagcgcaggaggggtaggctgggaggggctgccgcagctgttcacttgggcaggacgtcagaggactcagacaccagcttcccatcacgtgtctcgatcttcttcacaaccacggccctggaggagctggtgcggctgaaggagctggagcccgcgccagagccaaagctggagcccaggctgtagctgaggcc

SEQ ID NO: 7889 - DNA, 633 bp, Homo sapiens
ttaatacgactcactatagggaatttggccctcgaggccaagaattcggcacgaggagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgcctttttttttttccctgaaattattattaattttcta

SEQ ID NO: 7890 - DNA, 574 bp, Homo sapiens
aaatcattcagtttaaggtcactagactttagatgattgaccctgcaggtttataaggcattctgctcagcagtcttgtaaatagtcctatatgaaagagccatgctactgttggacttggtcccactctggtcaaccttgataacgtcatacgtggcttatggactggatagcactggattccgccgcagccctggccatactgtgccacacgttggaagaactgtgggatgtagaatggagggactccttgtcagacagtgacagcatcatagcatatgcctgcgatttggactttctgtgtaacggctgcttaagttcctctggcacatgggaagtactaaaagaagacagctcagcttcagaatattgattatcttccattttcctcattttgaggctatctgtgaagtgccttatatgatctagagcagaaagtccacttttatattcttcctctttatacctcactggggatgtcttgcaactcatctccagggcactggtttcttcatagtcatcctcagggtttccttcatgtaaattacttgtcactggttcctttcctgttttt

SEQ ID NO: 7891 - DNA, 316 bp, Homo sapiens
gctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgcc

SEQ ID NO: 7892 - DNA, 398 bp, Homo sapiens
gtgagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcagga

SEQ ID NO: 7893 - DNA, 481 bp, Homo sapiens
gcattcacatcttctgcctggctttttggagtctccattattccatgacatagaacaaaacaaaaaattagtgaattaatctcgaagctttacttcttcattttcccccactggtgtctgaacttttgccaatgtattttcagccctgctataaactgctataagtgagatcactccaattttatgcagcagttttctgaacctttggcttgttcaatttgaagctgcttgtgaatgtaactttgttcaaaaagctgacagagatagctgcgagtgaaaactccttggcttaaaattgagccccttccgggcatgatggctcatgcctgtgatcccagcactttgggaggcccaagcgggtggatcactaaagctctggagtttgagaccagcctgggtaacatgcaagactccatctctatttttttatttaaaaaataaataagtaaataaaattgagcctcattttttaacctaattg

SEQ ID NO: 7894 - DNA, 139 bp, Homo sapiens
cagcaggagaggagccagggtcagtccacttggcctgaaagttaacgtcacatattcagatgtcaaggggtttctgtgcatgcttttgaagtattgtgtttgggcttttacaacatgtgcctcactgtttcgcatctac

SEQ ID NO: 7895 - DNA, 413 bp, Homo sapiens
atttcgtttcctttttccattttgtatacgttttcctttttttttttcagggcccttttgtcaaattctctcaacctcaaaagggatcacatggccccatttcctcattttttaattctaaaaatatcgggttccctacttggattaatttggctttttaaactgggacttttatttatatgtgcacattctttgggagggggttaggactctttcggttgcaagggtcaaaaactcaactcaaaggaccttaaacaagccccaaaagttaccgggtcacacatctgaaatgcccaagggagctcccaatcaagctggatcagcgagtcaaaccgtgtgctcaggaccctttcttgctaggtcatctccctgtggggaaaccaactgtcccattttgcccaggtctgaggggc

SEQ ID NO: 7896 - DNA, 295 bp, Homo sapiens
gcgtgggctgaccaggcttcttcctacatcttcttcccagtaattttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggtt

SEQ ID NO: 7897 - DNA, 223 bp, Homo sapiens
gctttctttctagcgctctctctctgtctgtatatgtatatatacttacaaaattattttaatggtaaataatgtgagaataacttacagatactgtgcctctctggccctgaacacttggcctgtatcctttaagagcaaggacgttctcttatacaactcaaggaggatcatcacatttaaaaattttgaggctgggcacagtgtctcacatctgtaatcc

SEQ ID NO: 7898 - DNA, 519 bp, Homo sapiens
ctgtctcagcatttttaataaaaacaaaaaagtggaaataatctaaatgttcaggtccaagggactggttaaataaagtatcatgttttgacatggatatactgtgccaacataaaatgacacttgcaaagaaaatgaaaaacaaaaagtatatatagtgtggttataacccggcgtcggggggtgggaacgaacttacatattggggttagggaggagcatcattgacactacttagtgactgataaaactatgaaggatttgttttttttttctactctagtgtgctttcaaatttttctttcccaagcagacatgagtttataaagcgaaataagacaatggaagatacttgcttcaacaaacctattctatcctttgataagacaaatctcaaagtataatattaataattctgctgagcaactttatccatctatttctaaagcaagcctttaagaatcaataaatggacacgcatggtggctcatgcctataatcccagcactttgggaggcc

SEQ ID NO: 7899 - DNA, 321 bp, Homo sapiens
gatgctctaatctaaattatgaaaacttgatatattttaaaggaatttactcagttgaataataaaccacaatcatcatgagtattttattttatataggcagacagtataaaacttttagatagttcattaataaaggaaaattgaacattttggaactttcatgtgattttagcaaactgcaaatcagtcaaatattaaatccgttaactccatgtgaaagtaaagaatcacttagaatgtacaatgtcacgttttctaattttataaatataaaatcagatatttttcttgtaagttttcttttcagaaatgaaaata

SEQ ID NO: 7900 - DNA, 220 bp, Homo sapiens
ataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaacc

SEQ ID NO: 7901 - DNA, 552 bp, Homo sapiens
gacagaagggatgtgaattaaagaatatatcagggatgatttttaaaaatcagatttggattaagaaacctgttgaattaatacttgcataacagatgtatcactgataaatacttgtaaaagatattcccaaataagcaataaaagtaccattttacaaccgaagtaatgcatcctgtgggtccatttgcaaagatatgccaacagaaatgcatgcagagctctggaagtgataatgcaaataaaacatttcacattataacttaaaataacaagtttggaaggaataaaaagtctgggagactatttgttttgtctaaattctgcttttactctggtcttttaacagttggcttttgataatgtattactgccttagtgtgttcctgtgtattgaaggaatacattgtctgacagaattgtggttgaaaatattacaagttctaaataataagagtaataaatatcatatcttgtttgctttgttgtcatagtcgcctgatctcatgcttccctgaattcggctggtgtcttgattacgatggaatcact

SEQ ID NO: 7902 - DNA, 550 bp, Homo sapiens
gtagaaaggacaagggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactga

SEQ ID NO: 7903 - DNA, 338 bp, Homo sapiens
cacaaataaaaataatgcatctcttcagggattgtccctctggagagccccccacccccaagcattgaaacacttgctctaatgttcccatagcatgggtactattttcagctatcaagaaagaatataatggggtgaaaaaaaaaaatcttgcagactatattgggtgtagtcccttttctcctaaggaacaaaaccataggaagaaaaaattgttgattagtgatgataccaccaagtagaaattggcaagatctaggaattggaattatatgttagtaaccttaaaaatagaccaaactcttttattcagtaattccacatcctgaaactcatcc

SEQ ID NO: 7904 - DNA, 489 bp, Homo sapiens
tacggctgcgagaagacgacagaagggtacggctgcgagaagacgacagaagggtacggccgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggaaagaagaccaaactgagtacttggaggaacgaagaataaaggagattgtgaagaaacattctcagtttattggatatcccattactctttttgtggagaaggaacgtgataaagaagtaagcgatgatgaggctga

SEQ ID NO: 7905 - DNA, 518 bp, Homo sapiens
tggcttgatcacagctcactacagccttgatctcccagtctcaatcaatcctcccacctcagcctcctgggtagctgggattgcaggcgcatacctccatgcttggctttttttttctttttgtagagacaaggttttgtaccatgttgcccaggctggtctcaaactcctggaccgaagcaatccttccacctcagcctcccgaagtgctgggattacaggcgtgagccactgcactcggcctctactttttgtttacatcttgtacttaatgctatttataagctgcttgtggtcatttgagttcactgctcctgccctgtgactgactctctccaaccttttccaccgagcaaacaacctttcccacactaaagcatccagtcacctttcctttatacttgctgactgactgcatttcaactaggttgttacttcaagcaaaaacatgcattttttactttatctctggtagtgaaatgaaaggttcattctctgattataggaatctcaatttg

SEQ ID NO: 7906 - DNA, 475 bp, Homo sapiens
atttattttaggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaagaaaagcagaaaaaacacagctttcttagtcaaagggagactctgttgacagaagcaaagatgctaaagagagaactggagagagaacga

SEQ ID NO: 7907 - DNA, 251 bp, Homo sapiens
aatgagagatatttcagtggacatctggacatatttatggactttgagtatctagcaagtagaaaggaaaaaaatattcatcatactctaatcatttttttatatctatcgagcttgtttcttgtaaacttttctttatcttataaaggcatatctcgcttttgtatcgacctgttccttaaaaaatgtatttgataaaacaggctaaaattcatttgagtattgaaaagaattctttttttttttttaaa

SEQ ID NO: 7908 - DNA, 236 bp, Homo sapiens
gtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatga

SEQ ID NO: 7909 - DNA, 279 bp, Homo sapiens
gaatttgccctcttcaggaatatgaaaattttttttttcttgaacagggtcttgctggattgcccaggctggagtgcagtggtgagatcatgggtcattgcagctttgacctcctgggctcaggcaatcctcccacctcatcctcctaattagctgggattacaggcatgtgccaccatgcctagctagtttctgtgttgttttgtaaaaatggggttttgccgtgctgcacaggctggtcttgaactcctatgcttgatcctgctgcctcggcctccc

SEQ ID NO: 7910 - DNA, 565 bp, Homo sapiens
aagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagaccttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactccc

SEQ ID NO: 7911 - DNA, 332 bp, Homo sapiens
tatcctggttttgggacagcggcattcttggcgccacctgtgatatactgcatccccggcgaacgtctgtgtcacttggaggagggcagcccgggcagcggcacctacacccgccacggctacatcttttcgtccttgccggctgtctgatgaagaccagtgagaatggcgcgcttccactggtgtctgtagtgagagaaacatagtcccatttactgccagatgtgggagctattgtaacctgtaaggtctctagcatcaattcacgctttgccaaagtacatcctgtatgtggggtccatgcctcttaagaactcttttcgaggaactat

SEQ ID NO: 7912 - DNA, 567 bp, Homo sapiens
cgacagagggtccctttgctctaggaaagcttggcccaaattgattttcttctttttccccctgtaggactgactgttggctaattttgtcaagcacagctgtggtgggaagagttagggccagtgtcttgaaaatcaattaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattag

SEQ ID NO: 7913 - DNA, 271 bp, Homo sapiens
ggagctgctttagcccctacgtggtgagtagatcgtctccacagaaatcagcggaggcttccacagtccctggttggaatggaaccggcggtgaggatgagaggcgctgaagaccagaagacccagggcgtgaacggggcgtgtcatccctggagtttctgtagaatttcaggcctgtctgcttgagcagcagaggaggagtttctgtgtgcctgtgaaagactgtgtgtgtgtgtgtgtgtgtgtgtgtgtgtgtgtgtgtgtgtgtgtg

SEQ ID NO: 7914 - DNA, 546 bp, Homo sapiens
ggtagtccaggcggctctcggtggcagtgagcatgcgctccggctccaccacgaacatgtagtagaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagacta

SEQ ID NO: 7915 - DNA, 588 bp, Homo sapiens
acagaagggattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagctttta

SEQ ID NO: 7916 - DNA, 293 bp, Homo sapiens
agcgcatgtctgtaatcccaaccactctggaggctgaggcaggagaatctcttgaacccgggatgtggaggttgcagtgagccgagatcaggtccctgaactccagcctgggcaacagagtgagactctgtctcaaaaacaaacaaaaaaaaaaagtcggccccgggggctcacacttgaaatcccaccattttggaaggccaagggggatgtttcacaaggtcaggaaatcgaaaccatccgggctaattttggaattttaagaaaaaacggggtttaaccatgtgggccag

SEQ ID NO: 7917 - DNA, 557 bp, Homo sapiens
gacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggat

SEQ ID NO: 7918 - DNA, 105 bp, Homo sapiens
ccttccgactgtgaaaagacttaagcctgggttggatggctcacgcctgtaatcccagcactttggcaggccgaggtgggtggatcatctgatgttgggagttcg

SEQ ID NO: 7919 - DNA, 643 bp, Homo sapiens
gagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaacgaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatg

SEQ ID NO: 7920 - DNA, 514 bp, Homo sapiens
gtccttctgcaagcatctacggcttagcgctaaaacaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttat

SEQ ID NO: 7921 - DNA, 368 bp, Homo sapiens
atttatcgggatgacaaatccatagaatatattcttttatgttaaattattatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaagggg

SEQ ID NO: 7922 - DNA, 495 bp, Homo sapiens
  misc_feature 419: n = A,T,C or G
cttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtcncactatagtggttctttatttaaggaataactcagctgggtgcagtggctcacgcctgttatcccagcactttgag

SEQ ID NO: 7923 - DNA, 511 bp, Homo sapiens
ggtcaggagtacacgcctgtgtttttctacccataagtcagtgccaactcacaggttttaaagatttctgttaaatagttccttttgtcttaattttaagtatctagcaactcaaaatttgcctcctatatggaatttatttatttagttatttttattttattttgttgagacagagtcttaccttgtagcccaggctggagtgcaatagtgcgatctcggctcactgcaacctctgcctcctgggttcaagtgattctcctgccatagcctcccaagtagctgggattacaggcacccaccaccacgcccagctaatttttgtatttttagtagagacaaggtttcaccatgtttgccaggctggtcttaaactactgacctcaagtgattcacctaccttggcctcccaaagtagctggattacaggtgtgagccaccgcgcctggcctctgggattctttttttttccagttgtttctacttacagaaaaatgatttattaaaatgg

SEQ ID NO: 7924 - DNA, 601 bp, Homo sapiens
aaatcttttaattagttattttatcaagacttgagacactttctagctactgctctctagtttaagaataagcttcgtaaaccagaagaattaaacatttaaacataaaattaatgccattttaataattcatatccgaatcatttgtatttttaaaagtattttaaagcaggccaaataaagacatgaatcattaacattatttgaatttacattaaggaaagtatattttgagacatggttgatgtgttttcaccaagaagtaatttatggtcgtggaaaagaatttaataatcttcttgtatagtctcataacatcaaatcaggatctgattagtatttttttcttttgataagggaagaatcaatgtctgccctgataagttacaactgacttactttgtaagtactcatcccaatagatgtcataggccaacagattaaaaaccagagaatccagatgtcaactatgaattcaaaaaataactgaccactcctaactgaaaattttcaatattaaattacaataggtaggccaggcgtggtggcttatgcctgtaattccagcactttgggaggccgaggcaggtggatcacttga

SEQ ID NO: 7925 - DNA, 596 bp, Homo sapiens
tggattgctgatttaaagaggcagcctccaagaggcagagaatgagagcaacacttatcacatttgattgacatcaaatccttttatcaggtaatatctcaaagaactagtgcctcggagaaattctagtttagaaaatgctgtgcactcaaacattctcaattcctggtatgaaccaaaatttaggtgcaacatagcaaatggttaaaagcaaggatgctggagcccactatgctggatccacaacttactcttctgtgaccttcagcaacttgcttaacctctctatgcccaagtttcctcatttgcagaacggcaagagggaaaatgacaagagcagttacctcatagggtcatactgaagattaaaatgaatgatgcagtggctcatgcctataatcccagcactttgggaggccaagagggatggatcacctgagatcaggagtttgagaccagcctgaccaacatggtgaagccccacctctactaaaaatacaaaaattagccaggcatggtggtgcatgcctgtaatcccagctacttcggaggctgaggcaggaaaatcgcttgaacctgggaggtgaggttgcagt

SEQ ID NO: 7926 - DNA, 629 bp, Homo sapiens
gagtggtcagagctgaggcccagaaggcaggcagcacagcacaggcagagagaggcagagatttgcagcaaatgctaaggatgtgggacttcatcatgtattcctaacactcactgcagtgtgaggaatggattggagggacacttgcagtagttcttgggagattatggtccctggaagattgtgggtggtcaggggaggggaaagtgtgtgcttttgtgagacacgtggtaggtaagagtaataggcatcacttattcctgcagagtgatggtggtggccagggaaagggagatttgaggtgatttccaggttttcagacctactcaagtgtatggaaagtgataaccttattgaaatagagaacacttagagaagaaccattagcaggagaactgtgtcagtctgttttaggacatagcaaggtgcatttgagacatgcagaacaggtattaatagtaagacatacagatccgaggccaggcacagtggctcatgcctgtgatcccagcactttgggaggccgaggtgggtggatcacatgaggtcagcagctcgagaccagcctggccaacatggcaaaatcccatctctactaaaaatacaaaaattagctgggcatagtggta

SEQ ID NO: 7927 - DNA, 76 bp, Homo sapiens
gttgataggttgagaggccgggcgtggtggctcacacctgtaatccctgcactttgggaagtgggtggatcgcctg

SEQ ID NO: 7928 - DNA, 481 bp, Homo sapiens
tgtcaggacttaaatagtagctgggattacaggcacccaccaccatgcccggctaatttttgtatttttagtaaagacggggtttcaccgtgttgcccaggctggtcacgaactcccgacctcaagtgatccgcccgcctcagcctctcaaagtgctgggattacaggcatgagtcaccacgcctggccaggaagcagtcttaagggcgaaagacgctgtactgaaacagagctaggcttcgtctcccttcctcctttcaggtctgtggctagtatatagttaatgtgccaggacttaaatgctgagtcacctaaaaagctgagcctcaatcctcaataaccaggaagactcatataggctgcaactcccttccagaggagactgcccgtgttgccttttgctttcatctaatgtctctttactttacaaagaataatatgatctaaaatctgtctctgttgtaagcagtcactgaatatt

SEQ ID NO: 7929 - DNA, 464 bp, Homo sapiens
tacggctgcgagaagacgacagaagggaagcactttgatatccaggacttcgggaaaaaataaatcactgtttgcttatagacatagacttacccctttgactcttaaagagacaaacaagggaggttgtgtctggggcagaagaaaattttgtgggtataatgagattttggggccgggcgcgatggctcacgcctgtaatcccagctctttgggagtccaagtcaggcagatcatgaggtcaggatattgagaccatcctggctaatacagtgaaaccccatctctactaaacatacaaaaaaagaaaaaaaaattagccaggaatggtggcacatgcctgtagtctcagctactcaagaggctaaggcaagagaatcactagaacccaggaggcagaggttgaatgagccaagatcatgccactgcactccagcctgggcaacagagtgagactctgtccc

SEQ ID NO: 7930 - DNA, 579 bp, Homo sapiens
ccacccacctcggcctcccaaagtgctaggattacaggcgtgagccaccgcgcctggccctaagtgtgtactcttggggcgctcgtttagctttgtgggctagggattatggtgcattatctgataaattagaggaaaattttactttatctgagaaacatatttgcagccagtctcagacacactaagtcacagaagaaagaagaatcaaaataaagagaattctgctgtcagctgtttcccctcttgctttacctaaaaaaagcagccatctgtgccctgaggcagacatggcagaatgtgcttactcaacccctgacccccgactcctgacccctcaaaacacacactgggagcttagagcctgcccccaggctgcctctccccaccctttactcctcaaaatacatactgagagggaaggggatgcctgcagctggtccaaactgcttctcttggactaagatatatttacccgggggtgtcaacagcgtgggagtggagagagcaggcaaaggggagcagggaggtcctatggccttgcagaggacaaaaccacaaatccctggcaagtgacct

SEQ ID NO: 7931 - DNA, 613 bp, Homo sapiens
gtatagatacattacaatttatccaatttacttttgatacatatttagtttttttccagcgtttgttcttgattttataaatgtatttctattgaatggaatagcttggtcatagggaatacctgtattcaattatagcagagtttaagctccttgtcaacttttggcattttcagacttttcattttagtcaatctgttgggtatgtggtggtatcttactgtggttttaatgcatattgccttaactactaacatgattgtgtatcttttattcatagtttaatggccatttttataacctcttttgtgaagtgccttttaaaatatctttcccatttttaaattgtggtatttatctttttcatagtactttgtaggagttttccctatatttgggatataagtcctttattgggatctatctacccatctatctattctcactctgtgccttgactttttattttttaaatattgtctttgaattgacatgttttaattttaacttagtcaaatttgccaactttatcctgtataatttctttgtatcgaaggggcttaacaaaatcatctttgccaatgtcattaagatattttctacgtttttctct

SEQ ID NO: 7932 - DNA, 578 bp, Homo sapiens
tgtgtatatatatatatatacacacccatatatacacatatatatacacatatatatacacacacatatatatggagattatctgattaaataagctctaattttatttttaaaatgaaagatttctgaaactttaagtttacagttcaacttattgttttgtaaaacaatgtagcagagactatattaaaatccatatgagaatgtgtatttgatagtttagtgaaaagctgttagcctaggatataggtgcaagtaatggaaacattttcacattaggtgaagagctcaaaagaaaaaggattagtggccaggtgcggcggctcatgcctataatcccagcactttgggaggctgaggcgggcggatcacgaggtcaggagatcgagaccatcctggctaacacagtgaaatcccgtctctactaaaaatacaaaaacttagctgggcgtggtggcgtcgcctgtagtcccagctactcaggaggctgatgcaggagaatcacgtgaacccgggaggtggaggttgcagtgagctgagatcacaccatggcactccagcctgggcaacagagtgag

SEQ ID NO: 7933 - DNA, 562 bp, Homo sapiens
tgtattcttcaccagacttgtctcagagcagctgctcacccaggagctccatggccacagggatgcccaggacagggacgactgcttgcccactgccgtgctctggggctctgggcagtccctcggcctcacccactgctcagattttctgcaggaaaaatgggagagccaccctttcaaagagtgacccgggcccggttcctcctcaaagcctttcggaatgaatctcccagttccccactgactggacatagaacctctgctctttccttctctaaggctgtgctagtccattattcattaaaagacaaaatgaggccgggtgcagtggatcacgcctgtaatcccagcactttgggaggccaaggcgggcggatcatgaggtcaggagatcaagaccatcctggctaacacggtgaaaccccatctctactaaaaatacaaaaacaaaattagccggctgtggtggcgggtgcctgtagtcccagctactcaggaggctgaggcaggagaatggcgtgaacccgggaggtggagcttgcagtgagccgagatcgtgcca

SEQ ID NO: 7934 - DNA, 593 bp, Homo sapiens
actttcccccttaggtgttgagttcaagggaattcccagtaaacttgctgcacaaactctatttcccagaaaaccaaatctaacacactcactcaagaatatgaaaggatattccagcatttttaataaaaaactctctaacatgaaagacagtccaaatcaatgcatggagaataaaggaacttgaaagagacacatagtgtagagaatattaacattaattgtttaaagaggtaaaaattctgtattcataaaataaaaagcaggatgttataagaacagaactttcagaagacaaaaaagaggcccttggaattcaaactacagtaatgaaaatgaaaactctgatagactgattaaaagacacatttgtggcactctccaaaacatagaacaaaatgaaaagaaagagaatatgaaaaacaatatgagaaaattagaagattgagaaagtacaacatttgactaataggaattctagaaagagaacaaaaaaacaaaacagaagggcaaaatttgctttcaaaaaaattaataaagaagatgaaagggccgggctggtgactcacgcctgtaatcccagcactttggga

SEQ ID NO: 7935 - DNA, 640 bp, Homo sapiens
tagcagggaaacctaagtccagaagtcaccccatcatgggtcccaaaatattccataggctacttatatggctgtgtgtgtgtgctgtgtgtatgtgtgctatgagtgcatgagtacgtatgttctgtgaatgagcgtgttgtatgtgactgtgtgtttgtgtgtgtgttgggcacatgatcacgttatctctgttcagagttagggatggacggtgagagcaatgtcaacatcaaaacacaggagtcccaagttgatttttcccgtagatccctgtatcatatcctcttctgggtagcttctctctttccatagtgaatctgggaagatattccattaccacagcaatctaacgtgtccacagtttggaaagaagaaactaaaagggttctgagaaaagcatcctctctttccacccctacccccatcaccaaaagatgaaagatggtaaataggatctatttttaaaagacaaaagaagctgaaattattaaatccagaaggcaacaaaaggctaaaaagggtgaatttatcattgcatgtgtgtacacaaagtatttttataaaaagggtgagtcgagatcgcgccactgcactccagcctgggcgacagggcgaaactccgtcccaaaaaaaaaaa

SEQ ID NO: 7936 - DNA, 473 bp, Homo sapiens
taacaaaattttttttagatacagagacgccttctgttgtccaggctagagtccagtggtgtgttcatggttcactgcagcctcaaattcctgggatcaagtgatccttctgcctcaacctacagagcagctgggatcacaggcgtgtgccactatacccagcttctttaagacacgatcttttaaaatgttccttagttaaggcaatagactcaagtaatgatgcgttacttacatacataagcaacctattaagagtctattagaacatttaatatctcatactatgggataaaggtcccttcctccttttggcttttgcttttcaaaattataatttttagtatcgttcttcctttgcatggctttttccatcaacaccaaacagaaccacagtggaacagagtaacaaagaaaaagcaccaaatcaggcgaggtgcggtggctcacacctgtaatcccagcactctggg

SEQ ID NO: 7937 - DNA, 144 bp, Homo sapiens
ggatgctcaattataagtataatgcaaataggcaaaacaaacaaatccaaactctgaaatatttctggtccctggcattttaaataagggatattcaatccgtatagatattctacatagtcaaactttaatggacttactcag

SEQ ID NO: 7938 - DNA, 616 bp, Homo sapiens
  misc_feature 287, 288: n = A,T,C or G
gtgacaagtgttatcagactgagaataatatacaggcttactgaacatctgtgaccaacaaaagtgccaaatgcctatttaatcctcataaaaacgtatgaggtattactattctattttacaaaggagaatagtgaagtacagagaggttaagtaactgctgagccagggttcaaacccagataactccagacccctcagtaagagctgtattgttccaagggatacatgagaagactggaggaaggaattttaaagcaggaaagaacttgtctgaaaactatgannaatgttaataatgtctactacatgctaataatgtctactaaagtacaactgtgaaaaggttgtcaacaaaaattccttatgacccaaggaaaactaaatttgcgtcccaaggctcttaagcaactgtatttaaactctgcacttaaaaattcatattacaaggccgggcacggtggctcacacctttaatcccagcacttgggaggccgaggcaggcgaatcacaaggtcagaagttcaagaccagcctgaccaacatggtgaaaccccatctctaaatacaaaaattagccaggcatggtggcacacacctgtaatcccagctactc

SEQ ID NO: 7939 - DNA, 580 bp, Homo sapiens
cagaagggttattaaaaaaaaagaaaaacagttttgaaaatgataaactaaaggtatagctaacataacttttggagttttcatacacggattaagtatcaacatctcagaagtcaaaaatgacacagtatttaaagtttaaatttggtggatgaataaatgggacaatatttatttataaacactcaaaatttacctagtattaacttcaaaatattaacaggattagaatttttaaaagatgagagccccctagtggaatatagttcttattgcaatatttcaaaatagattaaaaaatgcttaagatctgttcaaaaccaaaaacatccctttagagtaactggactaaaattatgcgacagaaaaaaaaaacattaaactattactttctcagtacttcattttcagatggaactttaagaaaaagaatagtgccaaagggaaaggttagcaatgagcacagggataaaagcaaatgtagcccaaggaagcagtctgctctgccataaatattaaatgttggttttgccatttttttaagctgaatttctgaaagcagaaatagctgaaaagcaac

SEQ ID NO: 7940 - DNA, 569 bp, Homo sapiens
cccaggctggagtacagtggcacaatctcaaggtggcgagtccaagcaattctcccacctcaaactctccagtggctgggattacaagtgtgcatcaccacgcctggctagtttttgtatttttagtagaggcagggttttaccatgttggccatgctggtcttgaactcctagcttcaagtgatccacccgcctcggcctccaaagtgctgggattacaggcgtgagccaccgcacccagccgataactacatttcaaattcagttacagtcttgtttaaccccatgataattgtgatctcctttttctctgggcctaattttctatttctagttttctagcctattgtaaagaccctttatgctcttatggacaagagaggagataaaattaacatttggtatgctgattttagaattatttctgcaatttttacaaagataaatgcaaagaatatgtcctatgttatgatatttaaagaatttgtagaggttactccgggcatactgcatgcctatggggtagctctgttccacaaggagcaaaaaaaaaaaaaaaaaaaaaaaaa

SEQ ID NO: 7941 - DNA, 123 bp, Homo sapiens
aggccctatctccaatctttgcaagaccttaattgtgattcagatcccacttgcaatggactgcatgactgtaccccctacccccaaatccatatgttgaaatcctaaccccaagtgtgatga

SEQ ID NO: 7942 - DNA, 515 bp, Homo sapiens
ggccagagtgactgaaagtgcatggctccaggtaggtgacatggtactgtataagttttcttgacccatggttggcttcttgagtcaatggatcagagatagtttcgaggtagacagccacatttctatgccccaagaacactcgagatccctctgcattctctgctgctgtctgatcacgtttttgtttcaagacaagcagctcaaactgtcccacagcttagcaagctatagctcatgggccaaatctcgcctattacttaaaaaaattattatatttttggttttaaatttggggtaaaatgcacataacataaaatttgctatcctaacaatatctaagtggcattaaggacattcacctggttgtgtatccatcactaccatccatctccagaacttttcatcttcccagtctgaagctctgtacccattatgcactagctttcacttccctctgctcccagtccctggcaacctccattctactttctataatttgactccctgggagc

SEQ ID NO: 7943 - DNA, 154 bp, Homo sapiens
tgcaaatctccgtggcccatataccagtcaagagtacctgacgagcccttagagcccatttttattcccaagtaagtgattggctggatgacttcccttacctactttgtccagaggctgttcacctgggagacctgctggtatatgggccacg

SEQ ID NO: 7944 - DNA, 533 bp, Homo sapiens
tttacaaagctatactcatggactgagcaatatagaatccttctcatcgtatcttgttacagtctaaaaccttgtagtaaacgctgtctaatattccactcagtaataattttttctttttgagacggattctcactctgtcgcccaggctggagtgcagtggcacgatctcagctcactgcaacctccgcctctcgggttcgagcaagcaattctcctacctcagcctttggagtagctgggactacaggccacaccaacactcctggctaatttttgtatttttagtagagacagggtttcaccatgttgtccaggctggtctcaaactcctgacctcaggtgatccacccgcctcggcctcccaaagtgctgggattacaggcgtgagccaccgtgcccggcctccactcaataagaattttcttaccaattctccaaacttttgaccatctgtaccatataagtaatgctgaaataagtgttcataggcatgttacttttcctgtatttggaatgactaactatactac

SEQ ID NO: 7945 - DNA, 387 bp, Homo sapiens
aatgcaccttcaccctgagactgtctaaaaaccaagcttggctgatatttggaggatcctaggccaggcgagcggagcagctgagtcacaccctgtatgatgtgtctgcaaatagatctgggtcaaaatgaaatacccccttgcctggctcagagagaggcaatggactgtgtgaactcactgcttccctccatctgggcacagtggttgctgaaaagaggaagtcacagcctgggagagttgggtagcacagacaattctcgagttttgaaagctattggcctcaatgagccccgtgctccatgggaataaagggcacaagatcctccaaccccattttgcatttccatgttaaaaggtgtgtgaattcagtgcaaagagatgtag

SEQ ID NO: 7946 - DNA, 450 bp, Homo sapiens
  misc_feature 45: n = A,T,C or G
gctgtacctgggacacaggtgagtgaggaggacctcaaccccggngagtgattacgccctggcaccaggcccactttccttcgctctcaaagataccgctattgacacatctgagccggactgggaactttgagttgtcttatggctgcaatcactgatttgtgttaatcacccctttcttcccttgattctcacttactgtcccacatgactcctctatcatagatagtaaataaaagcttgaatgcacgcatgaatgaacggaagactagactggcccaatgtgggatctaggactgtgactacatttttttatttgttgagccaaagaagtcccataaaagaaggggtcttactcccatcaatcaaagttaagactgtacctggggctttttctacggcatgagtcagcctttacagtgaggtctgctttgcatctcctcacccatc

SEQ ID NO: 7947 - DNA, 559 bp, Homo sapiens
gcaccccacccaggctgggatttcagcccaggcaggctcactgcagaggcctcgcccttcaccactacccaacaggcgaccctctcctgctacttctctcgtaggatctgaaacaaatacagcagaatgttcaggcactatcgcgaggctgggtgatgggggtgtgcgtctctgttatcattttatgaatgcctgggatgcttcggattggaaaaggagataaagggactggcatggaaggaggaggaaggaacaggagtggcgagtggctttctctcttcctctcaggtcccgatcccagaaagagctagaaagcagatgtcgcaagaccccggaacacaggattcttttcctctggaatgcgggtgccctgttcctgcctggcctgaaggtgtgcacgagctcccaagatgaagggttcacgtctgttcatgcctcctccctggctctggtaggtgtggcccaagctctgtgcacgacctacctaccagcagaattagagacaggaggggatgcaactcccgtgaggcttctgcaaaccagtcccgagggtgaattt

SEQ ID NO: 7948 - DNA, 395 bp, Homo sapiens
agagacggggtttcactgtgttagccgggatggtctcgatctcctgacctcgtgatccgcctgcctcggcctcccaaagtgctgggattacaggcgtgagccaccgagcctggtcagagacaggaatgttataaagacgtggatgacagtgacctcccgtttcccgggtatgtcgcatgggccagacggttgcttcacgcacatcctacccttcctcctcctgtagctcccaaagaacattattcacatcacccccattgtggagatgaagaaactgaggcttagagaagttaagtgatgtgccccaggttacacagcacacagagctagacacgggcagggctgggatctgaacccaggtctctccaatgcctgaatctgacctcttaatccta

SEQ ID NO: 7949 - DNA, 578 bp, Homo sapiens
gatatcatttttttctgactctgatttaaaaatctctgtttaccaagatgtttcctggtatgtggtagtgaatataagtgtatttaaaatttcgaacagcgaacttacaaaagaataatcagaataaacttatttttgacttgcaaactttctgtttagtttttatagtaaatcagtaactctagctatttttagaagtcattccagtttgatccctatgttttatttccatttcttgtcattttttatgagttgttatgtttgtttttatagaagaagaataatatgtattatgtgaaagtaatagccaaactttaatttcattggtgtttcttaaaaatttctattaaatcgagtacagcatggattagaaaaataaagccagaaatcaatatcagaagtttaaagaagattgtaattagtaatttgcctgagttacagtcaaggataaagctaaaagtctcagagtaaatgcaatcacagtaagaaagataagggaaggccgggcgcggtggctcacgcctgtaatcccagcactttgggaggcggaggcaggcggatgacaaggtcaggagatc

SEQ ID NO: 7950 - DNA, 668 bp, Homo sapiens
gtggctcacgcctgtaatcccagcaccttgggaggctgaggcaggtggatcacttgaggtcaggagtttgagaccagcctggccaacatggtgaaaccccatctctactaaaaatacaaaaattagctgggtgtggtggcaggcgcctgtaatcccagctactcgggaggctgaggaaggagaattacttgaacccgggaggcagaggatgcagtgagccgagatcgtgccactgcactccagcctgggtgacagagtgagactccgcctaaaacaacaacaaaaaagaatgtgatgcctcagtatagagcatttgggaacccggttaggatggaaggcgagggctgggtaaagtctcttttgctgactgtgacaagtggccgttacaaatactggtgtattgcaaaacttcatgaggattgatttacagcatgtgccgtctttgtaaatggctttacatccgggttgtgctttcatgttccaagaaaacaacttaatctcttagttaatgaaaagtggaaggccgggcatggtggcaggcgcctgtaatcccagctactcaggaggctgaggcaggagaattgcttgaacctgggaggcggaggttgcagtgagccgagatcgcaccattgcactccagcctgggcaacagagtgagactccatctc

SEQ ID NO: 7951 - DNA, 652 bp, Homo sapiens
tcccaacaggccccacttccaacactggggatcacatttcaacatgagatttggaggggaaaatacatccaaatcatgtcagaaatgaatcttaaacacttctaaaacaacagttactaaggaatcagttagatagaaggagtacgttctagtattcaatagtacagtagggaagtgatagtaaacaatgctgataatctgaagtggaacagtttcatgccaaaactatcccccaccagtctgtggaaaaattgacttccatgaaactgctccctggtgctaaaaaggttggggactgctggtttagaccacattattcagagttgttctagtaattattctggtaatttgtctcatgcaatagaaaatacatatgaacactaagaaatctagaaataattcttctcataataaaaaatataaaaacttggtaaaatataagcctacaatattttttctctatattcaggtataaagacagtgtcaaccatgtgacatttataatattcataatctatatttgcaaaaaaaatgtatcatggaatttgagaaggtttagattcttagaaatttcttataaatatttaaacatggtcaattaagggcattgtaattactctcttaatttgcattaattagtttagactctact

SEQ ID NO: 7952 - DNA, 575 bp, Homo sapiens
acgtgccaccacacccagctaatttttgtattttcagcagagacgggatttcaccatgttggccaggatggtctccatctcttgagctcgtgatctgcccacctcccaaagtgttgggattacaggcgtgagccactgcgcccggccaaaagaatcctgtgcctcagcctcctgagtagctgggattatagacacgagccaccacgcctggcccccaaaggtatttaaaggaaaaggtatttctgtcaggatttaaggattctgatcctgagtagtagcaattccatctgctacattccagcctaagtgagtgggcaaaaagagactacgcttaacatcagaatgaaagccaaagtccttacaatggcctacaaaagacctatataatcttactccactacctccttctgctccttaaatgtgatgagtatgctcccaactcgggcctttgtatttatcttccagcccagtggttcccaaactttacagtacattgaaattttcctggctgggcctggtggctcatgcttgtaatcccagcactttggggggctgggcggatcacgagatcaaga

SEQ ID NO: 7953 - DNA, 581 bp, Homo sapiens
gggcacatgcactgccctcagcatagccgccttagcacttcaggacttaaaaggacctcagagtcactgaatcaaagctccctgagagtcaaattcctctgtgaattcctttcttgcagggagggtggggagaactgtccaaacctcagtcttttgagggtgagtttaatttttgaaaacagcaaaacttcagacaaagccaagtctagtgaagaaggtcaacaaccaggatgaacacattaaaataaggtggggccaaaagatgacaaaactggtttgcttctctgacccacaaaatggttctgagaggtaattccagaagcacctagagtaacaccctcctcccactgctgctgccggcacaacctctccaagggtggatagagagctcatattaacatctttaaggctgggcacagtggctcacgcatgtaatcctagcactttgggaggctgaggcaggcgggtcacctgaggtcgggagttcgagaccagcctgaccaacatggagaaaccccatctctactaaaaacacaaaagtaatctggcgtggtggtgcatgcctgtaatcccagctactc

SEQ ID NO: 7954 - DNA, 135 bp, Homo sapiens
tggggtttcaccatgttggccaggctggtctcgaactcctgactttaagtgatccgccctcctcggcctcccaaagtgctgaaattacaggcgtgagccaccactcctggccccttacaattaattatattctac

SEQ ID NO: 7955 - DNA, 81 bp, Homo sapiens
aaagatcctcctgctcagtttgaatcgtgaggtaaggctcaccgtcaggtctggggatactgggcattatctttggtcctt

SEQ ID NO: 7956 - DNA, 267 bp, Homo sapiens
gagggttcagttgagtcttttgcttcagcctcccgaatagctgggattacaggcacctgctaccattcctggctgaccttttgtattttcaatagtgacggggtttcaccatgttggccaggctggtctcgaactcctgacctcaagttaccagcccaactcggcctcccacagtgctgggattacaggcgtgagccaccacacctggccagggtataataaaatgcttaatagaactagtctaccctcaaccggaacaatgaaaat

SEQ ID NO: 7957 - DNA, 58 bp, Homo sapiens
acgcatggaatgtcaaataatatattctaatgaatctaatgaagttagagagaaaatg

SEQ ID NO: 7958 - DNA, 575 bp, Homo sapiens
tgagtccttgatgttcttacagctgttgctgatcactttttggggggttttgaggaaaaactatgaaattgattctagacaatttaggcttttgtggttcactggggcccataaaactactgagctggggaagtgtgattgggagaataatgatatttattcaacgataatgtgcttcacatacataaagagaactctgcacagcccccgatagaaagttacggaaacattctcaagttagaaacagtaaatgttttgaaaataaagtggcactgtcttagaaatgcaagaaggcagaagcaaaatattagatttgataattaagaatataattaatgatgagaaaccccatattttagagtaagactatatcccatttatcatggctttcagtcatttgaaaatttatgttcgttagtttgattgtattttccaccagctctaaggaggagctggaagggtgtgtacttttttcattaacattggattgcaatattcaggcacctatctgttcttactttaaacagaataatttaggaatgttagttctaaactcaagctgagacaagataaag

SEQ ID NO: 7959 - DNA, 522 bp, Homo sapiens
agggctgtggcaagccatatacacaaagatgcctgtttcctgtcttcttggttaaaaacaaaaacaaaacactggaaggaaccccaaagccaagctgccatgggttgcagagtgccagcccttaagtagtgttgttcatgggtaaacaggagacggataagggcaatttcaagaaataacaaactcaaggcatgaatgtggttatccaaacatcaagggactccttcatttgcatttggataattgtgcagttatatgatttgttacatggagaccagatggaagtaagagagctcatcctcaacttcctgtacctctggaagtctttacacacatgctggaaagatagaggagagttcattagcatcaaaccaccatggatttcataatcaattcctaatatctgaatagatgcagaaaagtcacaggcatctaaaagtgtggcccaagttctgttcttcaatcggcccaccaattatccctatgtatctcgattttgttatctaaaagatcacatgatgg

SEQ ID NO: 7960 - DNA, 278 bp, Homo sapiens
  misc_feature 61: n = A,T,C or G
tctctcaggctggtctccaactcctgggctcaggcaatctttccagttcagcctcccaaangtgctgggattacaggcatgagccacctcgcccggcctgggtggatcattttattgcatctcccttctggggcacccctcaagtgaatatatcatttacatcccgtgacagataaagaaacaaaaacacagaggtggaagatgaacccaggtagtttggttgcagtgcccagactaaggaattaattgttctctatcaaaaataaatttatggacct

SEQ ID NO: 7961 - DNA, 471 bp, Homo sapiens
cgtagaaatcattaaccacaacccacaatatgactaaatgtaatttatataatgctactatcacagcaaggtatttcttaattatttgggcattttaaatatttagcctaactacagactaaatttgaggaactgtcctgaatattagcaaaatggcttttctaaaactgaaaatttcattaagagactagatatttatacatgtgtagaaactgtgcattttcgattgtgcccctaaaggaacacaatattcttctgtgagatgggttttagggtggcataaagagcaaatgaggccaggtgtggtggctcatgcctgtaatcccagcactttgggaggccaaggcaggcagatcaactgaggtcaggcgttttgagaccagcctgaccaacatggtgaaaccccatctgtactaaaaatacaaaaattcagccaggcatggtggcatgtgcctgtaatcccagctactc

SEQ ID NO: 7962 - DNA, 588 bp, Homo sapiens
tattatgataggttattgtaggacacagataaaatcaacttttttcatttgtttctttataactattttaagttatttccacagttaatgaattaattttagcatagttttatgaaaagatggaaaggacccagacaagttgagtacaagtttctgataattttacaatcaaactgtttagactgggtaagaattgtgagaattctaatgaagagaatgactcttatgaaactactaatccaggcaaaacaaaaattaattgaacatcatgaaaatactctaccacatttttatactaaattagccagtactaaaattgttttagatatgccgtttgaataaactctgtggtacaagtcaaattatgtatgataacttctcagttatcagtgctatgcacctgaattgaagaaacaaaccagatattgaagaggacataaatttaatgttgtgtgtggactcatggagaacctagacagccaacagccacttgtttatttctgagttcttaaagtttcctctatcaaaatcactgcatttaattactcatcacagaagagataaaaaataaattaagttaaatataaa

SEQ ID NO: 7963 - DNA, 597 bp, Homo sapiens
agacccttgtgtaagagtcccttgtgtaagaaccatcttcactcgaggctgaacacatagaatgccgacaggctgtgttgtagccaattgcacatgctgacatttctgggccttaaccttggtgttgctaaaccatcccaacataatctgccccctcatgaaagccgtgttctgtagtcttgcctgaagatgggatgatggactaaacaggctcttaatgttgagttcattttcatctatatttctgtcccatgttcctttacctggattcctgtctctagtactgctgctatctcttaattgtccaatttaatcccagtaccactgccttgggctgggtactgttccttcatgactctcattccaaatagcttggttcataccccatattagtctgttctcacactgctataaagaactgcctggctgggcccagtggctcatgcctgtaatcccagcactttgggaggccgaggcaggtgggtcacctgaggttaggagttcgagaccagcctggccaacatggcaaaactccatctctactaaaaatacaaaaattagccaggtgcggtggtgcatgcctgtaattccagctac

SEQ ID NO: 7964 - DNA, 456 bp, Homo sapiens
taggtagaggtttaccttccctgcttggaaagcttctattagtgccacaattcatgggcttatggaatgccttgttttatcaccatgtatcacaaatatctttgagcaagaaagtaattttattatgagagaagtgtggcagcagagtcatgcccatggaattaactgatcttacccatcactcaggaacagctagtttgataggatagaggaaagtatgcagaaggatcaatcgtggtgctggctgagagaaaacccctgtaaggatgtagtataggactcaacccagtcaccattatatgttgtcatctactcaatattcagaatgcatgggcctgtgaaccaagaggcagaggtaggagtggctcttctattattcctaataactctcttgaaagtttttttctctacaactttgtctctattatattgtccctataggattggacttggtga

SEQ ID NO: 7965 - DNA, 114 bp, Homo sapiens
atagaagtccttttgagtgctggattttctttatttaggattcttttattccatcttggttccagcttttaacattttaaggacattgcatagaagttatttagggttaggctg

SEQ ID NO: 7966 - DNA, 531 bp, Homo sapiens
agtacctttatgtgtatctggtaagaatgctgcctctaccttttcttcctatttgtactatgtgaatgtggtgcatgaatgtgtggaatgtgtggaatgtgtagtattgggatgccagtatctttcagcgtgtttgggtatatgtccactgtgcataatatttgagatgtaaaaccattttgtgcggtatatgtgttattagttgtaagtcggtgaaatgtacatctgaattctgtgtgcatattgttggtactgatgctattttcgtgcatatgtctagtgtatatgttttaaggcaaactttctttgtgtgttgggtgtgtatgtgacacgaatggggacagcatctgtttttctgagcatggattgatgtgtggtgtctgtatgtatcttggaatggaggagggagattgaagaagtctggctgtgagcagcagaaataatttccaaagttgagtgacatgactctaagatgcccagtttctcggcctggggtcagcctgggtgatagctcagtctgtcagaatgaaa

SEQ ID NO: 7967 - DNA, 604 bp, Homo sapiens
cagaggatatatgggaggagcttgggagatgtgagatttgatcatgctgtgaaattcgagaggaggagatgactgacacacacagtgaggaatcaacgctagataagcatggggggtgggtggggagatgcttttgccgtgcactgtgaggaggcacagtgacatttcaatctaaggagagatgtgaggggtaaagagaggcctgttattagacttcattaaacagggatggtggaggctaagacatctctagaatcaaccgctggcagggagcatttctacttgtagtagaaatgttaagtggaatagttagcttctctctcattgcactccctctctctattaaaaatggagacaggccaggcgtggtagctcatgcctgtaatcccagcactttgggaggctaaggcgggcggaccctgaggtcaggagatcgagactatcctggctaacacggtgaaaccccgtctctactaaaaatacaaaaacaaacaaacaaacaaaaaactagctgggcatggtggtgggcacctgtagtcccagctactcgggaggctgaggcaggagaatggcgtgaacccgggaggcggagcttgcagtgagc

SEQ ID NO: 7968 - DNA, 145 bp, Homo sapiens
agaagggtcgaactcctgacctcaggtgatccacctcgcctcagcctcccaaagtgctgggattacaggcatgagccaccatgcccggcctactctttaataagtgtaaaatatctgtgatgaaacaacttagtctttaatcaaa

SEQ ID NO: 7969 - DNA, 495 bp, Homo sapiens
  misc_feature 432: n = A,T,C or G
ctggggcaaaagaatataatcaatatagaatttgtggacagtttttacacttaaaaaatatattatggcacacagattgttactttttaaataggcactgaacgacaagaaggaatgttttgccatgctctggcatttttttaaataaaacataaaaacagcagcattgtcagagattggggtagaaccaccttgtttggccctttcattactaatccaggagaggcaaagcacagggaagcccacgaggttttaggcaacattaagcttttacaggccaggcaatttcaaactaacaggaagtaatgcatggtgagaaaaaccatagaatgaagatgtcatcaacatgcaagaagagtgggaaatactggccagctgcctcactgtaagaaaaggaataaaatgcttctgggggtaaataatacaaataantactctaagtgtagatgatagattctgagctctgacttacactcctagaaagtaacctaactg

SEQ ID NO: 7970 - DNA, 588 bp, Homo sapiens
ttgctgtcagccagacggcagctgtgacttagttgtgttaaaacctgttgacggccaggtgcggtggctcacgcctgtaatcccagcactttgggagtccgaggcgggtggatcacgagatctggaggttaagaccatcctggctaacacggtgaaaccccatctctactaaaaaatacaaaaaattagccggacgtggtggtgggcacctgtagtcccagctactcgggaggctgaggcaggagaatggcgtgaatccaggaggcggagcttgcagtgagccaagatcgcgccactgcattccagcctgggcgacagagcaagaatctgtgtcaaaaaataaaataaataaaaatacaaaaagtagctgggcatggtggcacacacctgtaatcccacctacttgggaggctgagcagaagaatcacttgaacctgggaggcagaggttgcagtgagctgagatcgccccactgcactccagactgggggacagagtgagactctgtctcaaaaaataaaaataaagtattatgataaattataacagtaatatatggtagaaatgagacccatctagtagtaagta

SEQ ID NO: 7971 - DNA, 350 bp, Homo sapiens
tataagtcatatttgaccggaagaacttgtttcttcagtctctccctatgagctctttcatctttagcgtttaaacccttttaagtctccatttttaaaaacactttccttctgtagtcctagtgggaggatcgcttaagcctagaagtttgaggctgcagtgagctatgatcacaccactgcatgccagcctgggaaacagaccaagaacatgtctcaaaaataaataggccgtgtgcagtggctcacgcctgtaatcccagcactttgggaggctgaggcaggaggattgcttgagctcaggagtttgagaccagcctgggcaacatagtgagacccttacctctact

SEQ ID NO: 7972 - DNA, 240 bp, Homo sapiens
tactagataatatggggatcaaaaggatgaaaaggacatagtctttgccctctcaaaagcataataattgagatatggttcatatacatgaaaaaaatcactattaagcaaaagggaacaaggttgcagttacctttgcagtgtgagtcttcacttaaaagaactgcttttcagccaggcatggttgctcacgcctgtaatcccagcactttgagaggccgaggctggcggatcacctga

SEQ ID NO: 7973 - DNA, 603 bp, Homo sapiens
atagtctgtcacttaccattgtttctgcaagccaagggcattttttatgattttacagttacctaatttatagtttataatataggaaagttcatttattctctaactatatgagccttaaatatcttggagatttttcctatgatttgccccagaaattaaaagcaattcagggggaatgaagaatgaaatagagaaataaaggaagtctgaaaattcagaaaataaaagtatagtttgggcaaagcaactctaacaatattatcatgagctatctatctttttcaataacaataataactcatggtaaagctctatttttttctcataaggctactttgaaatgcaaacacaagcggaaatagtattagaaataagcagtaatggattgtacctattttactaaatgctaatgacaaatatgctcacaacgggcagatgtgtgccttaaaaaagtggtcattttctaagattattaaagtttctgaaagccatccttaggctttcataggctataactgcattaaatattaaattttaagatttttcttgactatggaaaaatcgtggccgggcgcagtggctcacgcttgtaatcccagc

SEQ ID NO: 7974 - DNA, 567 bp, Homo sapiens
tagtattacttccaagaataaatgtgcatatttatagggaaaaatcaaaacataatttttcattctgattctaaagctttcacaagaaagacatttatcatatccagttccattaaaatattcacttcttttaatccacttcaatggtgaaaagaaaaagtaaattacatttttcacatttccaaacaccatccatttccatgacacacacaggtatctccttgccaagaaaagtcagtggttgtctgttttggaagggaagtaagaaagtggcattttttatttcctgaagaaaaaaaaattaaataggtcaaatacataaaacttccatgaaaagagccacacttcatttcagccattaaagaaaaatgtgtttaaattccccaaaggaaccctatgctctacactgggaaaggcttattcactgctgactttcaagaaccagacatgacttatcacaccgtgtaaccaaggcactgaatggaactgaaaccccaaggagtcttcttatctttctgctttctagataccaggaaaaaaaagaagcagttgagattattcactctt

SEQ ID NO: 7975 - DNA, 493 bp, Homo sapiens
ggagagagggacacaaattgattggcagaagctgaatgtttttcctttgctagactttcatccaatattgaacaaattattgcatttagctcaccaggttgccacagtctttcaatacatcagaccagcacagtacttattactttatagcaatagcaatgatataaaaatgaaaaatattgcttgaaaatgtcaaagagatttttcttttggtggtggtggttgggtaattcagaccattcattccattgaaaacaagcatcccaaatttgaataactcttaaaaaattcctcaaaagtagcagagctaataagataacgaggaattattgggttaaaattcagaacatgaaattcctggccaggagcagtggctcacatttgtaatcccagcattttggaaggctgagttgggcagattgcttgagcccaggagttcaagatcagcaggggaaacgtaatgaaaaactcatctctatataaaatacaaaaa

SEQ ID NO: 7976 - DNA, 57 bp, Homo sapiens
accctactcataacatcacacaaagtaaattgagttgaacagagttaacactgaatt

SEQ ID NO: 7977 - DNA, 281 bp, Homo sapiens
gcagccacaacctctcaggctcaagccatcctcccacctaagcctcctgagtagcttgggaccaccacaggcatgcaccactgtgcccagctaatttctgttatttttttgtaaagatgggggtctcactatgctacccaggctgtattttctgaactcctgggctcaagcgatcctcctgccttggactcccaaagtgttgggatcacaggcatgagccacaacacctggccaaaacaaatattttcaatgaaagcaaatggtgggcccttctcctcccc

SEQ ID NO: 7978 - DNA, 476 bp, Homo sapiens
cacgagggttcagagaaaagtaggcagagaaaggcagtttaggaggtgacacaagagggaagcctaaggagagagaactggatggagcttcccaggtgatgacagggttgaactccagggctatacccagctgagcaaggagagctttgcctcttcaggagactggaagttggggaagactccaacaggcttgtggtcagaagctcaggagactgggaaggaaaagtgaatttctgaggagtcctagttcatttcattaatttgttcaattctttaacgtatgtttattatggacctactatgttgccagacgctgtgctagctgttagggacacaatgatgaacaaaataggcatagttttttaccccatgagagttagagggtggtggggagagtcattaatcaaatggcacaaacacatgtaaaattaccataaagcgggtgatacagaaaggcgactggtgttaggatagct

SEQ ID NO: 7979 - DNA, 529 bp, Homo sapiens
  misc_feature 391: n = A,T,C or G
ggcacgagatcatattcaagttggcaggtttgactgttcctctgcaccagacatctgtagtaatctgtatgtttttcagccgtctctagcagtatttaaaggacaaggaaccaaagaatatgaaattcatcatggaaagaacattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcangcttatccaacaacagtggtattcaaccagtccaacattcatgagtatgaaggacatcactctgctgaacaaatcttggagttcatagaggatcttatgaatccttcagtggtctcccttacacccaccaccttcaac

SEQ ID NO: 7980 - DNA, 593 bp, Homo sapiens
aattcggcacgaggctgagtatttttttcaagtgtatcatttgcctgttaacttaaaattctattttccccctaattctatgtcccagttttggttagtgtgctctgggatttttgacccattccatagtaatagttattactactaccactacagtaaattcttacaagaactttccatgttttttgggaggaggaggaggagtagttacattcaggatcatatacataattgtttagcttcagttctgtatttatatatgtcacttgtaactgactgggatacgttctgagaaatacattctcaggtaatttttgtcattgtgccaatatcatagagtgtacttataaaaacccaggctatatattataacctattctgggcttcaaacctgtacagcatgttactttactgaatactgttggcagttgtaacacaatgataagtatttgtgtatctaaacataccaaaatatagaaaaggtacagtaaaaataagtttaaaaaaaaggtacaccaaaataatcttatgggaccactgtgtatgtggtttgatgtcattatgcagtgcatgactgtactataaatgcttat

SEQ ID NO: 7981 - DNA, 281 bp, Homo sapiens
ggcacgaggaactaatgaaaagtggttgtctctaaccttggtatgctttcagagcatcagggttaaattacctcaacttttggcaggtatactctaaagctattaagtatataatatgggctcggcatggtggctcacacctgtgagccacctagcactttggcagtccaaggcggacagatcacttcaggtcaggagtttgagaccagcctgtccgacgtggtgaaaccccatctctactaaaaatacaaaaaccgagcgtggtgggtggcatgcacctg

SEQ ID NO: 7982 - DNA, 156 bp, Homo sapiens
cagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacg

SEQ ID NO: 7983 - DNA, 257 bp, Homo sapiens
cccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttcccctttagctttagacccctt

SEQ ID NO: 7984 - DNA, 537 bp, Homo sapiens
tgccaacatggcattctgtttttgaaaagttacatgacactattaagtattgaaaatgttctaactagaaaaacgattttcttaatcatagtttttattgtggggtgtgtatgtaagttttaacgtgcaaattaacatatagaagtcactttgtgaggtttcatttaaatgtatttctcagattttgctgaatctgtaatagccattgaaatatttaagtaccttggctgttcctggcatcaataaacagatttttctttccctcctcatgccatacaaaagttgacaatagctttatcaccacaggaagaaagctgaccatcattgccctttatttgggcccagttgccatggttacagccctttagctaaattgggaatggtaaccaaaataacatttgcataacattcccttgttctgcccacctctttgcacatcttcaaatcaaggttttggtctgatcaccatactatgctgtagcctacttttaggaagtactttaggctaaatagatttgtttcatttatgctaaatgc

SEQ ID NO: 7985 - DNA, 589 bp, Homo sapiens
ggcacgagataacgcccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttgcatcatgaacacctggaaagacgagaactatttatatgacaccaactatggt

SEQ ID NO: 7986 - DNA, 300 bp, Homo sapiens
gctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtattcagagtgctcgtatagccagcg

SEQ ID NO: 7987 - DNA, 415 bp, Homo sapiens
agtgacgtcttctgaaggaaagttcagcattttttctcagatatgataataatatatgctaagatcttggccaggcacggtggctcacacctgtaatcccagcactttgggaagccaaggtgggcggatcacttgaggtcaagagtttgctgccttcaaatcaatcattacttcttagcacctcttgaaatagaaaataaaaaatttggccaggcggtggccaggcgcagtggctcatgcctgtaatctcagcactttgggaggctgaggtgggaagatctcttgagcccaggagtttgagaccagactgggcaacacagggagacctcatctctacaaaaaagaaaaaaaaaaattaattagccaggtgtggccccatttgtacaaaaaaaaattttttttaattagctgggca

SEQ ID NO: 7988 - DNA, 558 bp, Homo sapiens
gaattcggcacgagtccaagaggagaagcatgttccaaaacccttaactttgggaatttagaactagcttttttactatcttctgcacagcataacttcagtctccctttactaattcaaggaaatctcagtgaacaaattgtataagggtagatgagctaaaagctcactgagtcattaatttgtcataactcatctaaatacaatgattaggcttgtgtaggtgtccctagtttctctttctaaatcatgtcttagtagggacagagcaataatggtggatcgtggcaacgggaaggaagatgatgtgtcagttatctattgctgtatgacagtcacaaaaccttagtacttactacagaaacaatgatttgtcacattttgtgggttgtctggatggttgttttgcttatatggtgcaggctgagattactcatgcagcttcacagttcttttgcttatatggtgcaggctgagattacacatgcagaggaaagatgggctctgttcctcattcgtatgcctggggccttggtgcgggttgtggcaatggcgtct

SEQ ID NO: 7989 - DNA, 163 bp, Homo sapiens
ggcacgagaggaagcattcacatatcctagaatagatgacttggctatcaaccccttgccggctgtagctccccatttgttgtagtctgtatgtgctatacccaacctagagcagggcgccatgcctggctaattttttttttttactttttacaaaaatggg

SEQ ID NO: 7990 - DNA, 560 bp, Homo sapiens
tataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataac

SEQ ID NO: 7991 - DNA, 519 bp, Homo sapiens
aattcggcacgagctttgcagccttttcctgcccttaaatttgatacctttggtgtaggagctgcataagtgacagttgctgcttttacgtttccacgcgtgatcttgaccctgctagcctgaagtgtatggtttctcttagccagttctaatttttgttcaagtggaagatggatgcctgaagtgtagactgctgctagctgaataccatctgggagcataaaggtgacctgaaggtagggtgatatgtcttaaagcactttgtaatgggaatttttatcaccttttaaattggggttccttctctagtgagttttaatgtcagtggtacattcgtagtgttgctctgtctgtagctattaacgtgagttaataaatgggatagcctccacagcttatttttgggaaggttttgctgatacttcctgagaagcccagggaaataaatacgcatagtactggcattctgcatctctttaagatttgtttttatgtgtagtaattgagttttttaaaagc

SEQ ID NO: 7992 - DNA, 530 bp, Homo sapiens
ggcacgagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcatcaatcaatcaatcaaatcaatcagtgagagcctggctgggctggtgtcattggtcagggaaatgcaagtcttctggtggttctgggtaaaagtggagacaataaatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttatt

SEQ ID NO: 7993 - DNA, 106 bp, Homo sapiens
gagaagaagaaggaatggatatacagaaatctgagaatgaagatgacagcgagtgggaagatgtggatgatgagaagggagatagcaatgatgactatgactctgc

SEQ ID NO: 7994 - DNA, 77 bp, Homo sapiens
gagcagtgcaagagtccctgtgctccagttccacactgctggcagggaaggcaaggggggacgggcctggatctggg

SEQ ID NO: 7995 - DNA, 377 bp, Homo sapiens
ggcacgagcctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgcccccc

SEQ ID NO: 7996 - DNA, 90 bp, Homo sapiens
cctggagacgaccctcacgtccgtccctcacgtctgtccctcggcaagtgctcctcactgtggagagggcagctgctgacctgcagcaag

SEQ ID NO: 7997 - DNA, 225 bp, Homo sapiens
  misc_feature 25, 26: n = A,T,C or G
cgcacgatgatataccgagagcatnnccagcaaggggacagaacttcagtggcgggtggagccccaaacccaagatttccaacccgacaacaacctctttggctttcacctggccttcagctctgccccagcccaggggtaggtgaggcccatcctttttctgcctatgggcctggctctgggcctcctctccccatggctcagcgagcactgagctggccctag

SEQ ID NO: 7998 - DNA, 294 bp, Homo sapiens
gagtcaaggcctacgaacaggtgatgcactaccccggctacggttcccccatgcctggcagctgggccatgggcccggtcacgaacaaaacgggcctggacgcctcgcccctggccgcaaatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatcc

SEQ ID NO: 7999 - DNA, 317 bp, Homo sapiens
ggttctggagcagctttggcacctgaaggctttggaaccaagggcagaggaccccctgtgctcagtgcaaaaatgagacaaacaaaatcagtctacagaggaatagttccataaatgagaactgacatatagatggagaaattgtgctaagcagtttcttgtgcacaaatttgcggagaaaagggaaacttggaaaaacttcgtaataactaaccattagactgggtcatgagacgtcctctgaaactcccaacagttctccaatacctttccatacacttaaattaattgccaacatctagcagtgacccatacat

SEQ ID NO: 8000 - DNA, 461 bp, Homo sapiens
gactgtatctcattggggatacgaagctctacacacttgaagatggtgaaggaatataaaaatctatgtctcacagtccagacttggagtacaagtaataagaagaataaaacttaatcccttaagtagattcaccataagttagctcagagcaattccagtgcaagtatggtctgtgatccagtagtatcttacagacagcaagttgaacattgtgggatgcatgagctattgaggcctttgcagctttctgctacatggaggctagggccagagtcaagatttatgctttgcagcacactggtcagctgtttttgcaaatcagattaaatgatttttaaatgaggctgagagcatgggagatactaatgtgtgtttccttgtgagctactgcataagttaggaaattgaaatacagaaagatgaaaagtgatttgcccaagcatatagatcaaagctgt

SEQ ID NO: 8001 - DNA, 539 bp, Homo sapiens
tgaggtccttcttgctgtgtcatccagagagtatgagaaagccagaaaggaaggaagccaaatttatcttttatcagtaaccaactcccaagataactaacccactcctgcaataacaacattaatccattcatgagagcagagccctcgtgacctaattacctcttaaaggttccacctctcaacaccattgcattgggatttaagttttcaacgcatgaacactttaagattcttaaagtggtttcttgagatagaatgtactgctatggcttgaatgtgtctctcacattcaagccatagcagttgtgcacatatactataaggcaacaggaatcatccataaacagggggtatgagtaagagtaaggtaactataaatagaaaacatatgtactgtgtacaaatagaaggtaagcttttaaaatggcattggcaggagcactgaagcagagatttcaggggacaagttatcataatggtgggggaacagcattcctgctgctgagtgggcttagaccagcctcctctgacttttt

SEQ ID NO: 8002 - DNA, 438 bp, Homo sapiens
ggcacgaggtggctatccatcaacataagtaaaaaaaaaaaacactttatctccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagc

SEQ ID NO: 8003 - DNA, 631 bp, Homo sapiens
atttaaattttcttatacttgacatgtggctcttgtcaattttataacttggccaacatcatacagttgtagtgatgaagctgagacttaaatccaggattttaaatctaaaactaatatttctaaccatatcagtgtttgtttttattcaattggcaacactttaatgtttcttttctttttatcagggcaaaatttgatccctataaggataaaatatattcttaataagttgaaaggttgtatattttaaaatttttggttgccgggtacagtggctcatgcctgtaatcccaacactttgggaggccaagatgggaggatcacctgaggtcaggagttcgagaccagcctgaccgacatggtgaaaccccctccctactaaagatacaaaattagccaggcatggtggcacatgcctgtaatcccagctactcgagaggctgaggcagaagaattgcttgaccctattttattttgatagtgaatttatccatgtttattttaattatgaaatatgcaaccagcccaaatgcccatcaattaattagtggataaataaattgtggtatatgtataccatggaatactattcagccataaaaaggaatgaaataatggcattcacagc

SEQ ID NO: 8004 - DNA, 300 bp, Homo sapiens
caaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacacggcttaagcccagacttgacgtaacagaaatgtgccaataggtaataggtaatttttctttctctgacttgct

SEQ ID NO: 8005 - DNA, 520 bp, Homo sapiens
ctggtcttgaactcctgacttcaggtgatccacccgtcttggcctcccaaagtgctgggattacaggcgtgagcccaccgcgcctggcttcggaattgcatcttaatctctgtggcggctgctattttgttttctaagttcatgagcacaggtggctgcctctatctttctcctccacttaagcaggaacaattcaggaggcagactccacccaatgctgcaaatcggccctattatcattgaccctgacagaatttcaggagtgtcaggccactccatactgcaaacagtacaggttgcttataatcgccaggaggaaagaaaatatccagcttcttcctggtgcaatcatggccataggaggaaggaatcataggaaacagagcaaaggaacaaagttcaaaacctgactttccacttggaagttctctcactaatcttaaaatcaaatataaagcttaaattgtaaatttagcggcatttccctctcagtaccctttccatattcccacaggtaagc

SEQ ID NO: 8006 - DNA, 381 bp, Homo sapiens
tttcttaacatttctagttgtctgcaaccatccctgtcttacattacattattaagttagttctattacaagactaatgaatgacagaatagagcaaacatggactttggagtcagacagacatgagtcagataagagttcaaacccactgactgccgtaaacttgggcaagaaatttaaccctgtcagggcctcagtgtactcattagtaaaggtaataataagtctgtaggaaataatacctacatacttacatttgacatatatttaatgctccagcttaataaggttggagtattcgataactgataaaaaaccttgcacagtattgagcaggtaacagacattcagtaaatggcagtaccattccgatgatacttt

SEQ ID NO: 8007 - DNA, 325 bp, Homo sapiens
agaatagctttcatcccaaaatttgcttggaaatagttagatcatttgatttaattttcacttttataaaataagtgtaggaatcctaaaattgattacttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaatt

SEQ ID NO: 8008 - DNA, 359 bp, Homo sapiens
gagtctcactctgttgcccaggctggagtgcaatggtgtgatctctgctcactgcaacctccgcagcctgggttcacgccattctcctgcctcagcctaccaagtagttgggagaataggcgacttccaccactctcgcatttgtgataggactttttaaaggactcggagtccaaatactaaaaacaggatggccggaatctccagacctgatgatcttgctgcctttatatttaaagtgccaggactatacgccgaataatgggtggcccccttgaagacgcaaccctgtcctttgcttatgaattgggtgttgtaccgattctcctgatatccctataggcaattgtcggaaatag

SEQ ID NO: 8009 - DNA, 355 bp, Homo sapiens
ctcttgcggtgagggaaagcaaggggaccatcccttgccaccattatctggtaaatcccccatgtgatgcctaatgccttccatccaggcatctaggcctaccccaaatcagcaagtttgaaaggactttgttgtttatatatacatttgcttcattcagctatgaagcaccctgtctcttaccagacctgcaccctccaccccactgatttgcttttgggttgttaaagggttgcgatacactgcacttgccagacatacctctaaaatagctgttgactcttgcctcatccctaaactctcctgctgggagacccctcctattctatatgcgacgctttcatgtgtgtacccg

SEQ ID NO: 8010 - DNA, 284 bp, Homo sapiens
taaggtgtcttgatgtagtaagcaagatagtttttacagtcctaggcttattacaagtttagtaaccccagtggactgagaaaatctttctcaatagctctggcaaaaaattcctctgggaaaatatgactgatgggagtttggatcatttgcccattcttgaaccaatcattgtatagttagccctctgtatataagggttccgcatctgtgtattcaaccaatcgtggatgaaaaatatttggaaaaggctgggcgtggtggtggttcatgcctgtaatccc

SEQ ID NO: 8011 - DNA, 355 bp, Homo sapiens
gatggctccccctatgaaagttgtccagtgagcagggtcaaggtttaggtttggggtacggacatgagtgcaggagccttactctcctgtgtgttgtcagggatggataaaggggatgaagttggaggggtttagtgaatggttgggacagcaaatttcagagaagagcatttggaaataattttctcaaatatatatttttaaaatccatatttgatttttttccctcagggattcccaagcatagtagagctaaaatgaattaatttgggtaaaagtaaagttaaggctaagttaggaaacacttttaaaaacaggaacctgctgcgtgcggtggctcctgccttgtagtccc

SEQ ID NO: 8012 - DNA, 382 bp, Homo sapiens
tgatccacccgcctcagcctcccaaagtgctgggactatagacatgagccaccaaacttggctagaaattttctcttttttcccttagacggagtcttgctctgtcacccaggctggagtgcagtggcggaatctcgactcactggaatctatgactcccaagatcaagagagtttcctacctaagactcacgagcaactgggattacagacgcctgacagcatcgcctggctaaagattatattaatggtcgagatgcgggaatatactgaaggttacgccggcgacaagactacttaatggggcggaggggagaatacgacttaaacggtcccgcttggacaagacgaggaaaagcctctatttgcgagaacaaaagaat

SEQ ID NO: 8013 - DNA, 338 bp, Homo sapiens
tgcagtggcacatacttgtagtccaagcttcagaaggctcaagtgggaggatcgcttacacccaggagattgaggctgcaatgagctgtgatagtgccactgcactcagcctgaatgacagagggacaccctgtctcaaaaaaaaagtcagtttctcacttggactaactactttttaactgttaatagctggtggctgccatactggacagcccaagactaaaggctcaatgggctgttctccactctctgtccaagggaaccttcctttatgtgctttttgctttcaagatggggtcttgcactccagccggggcgacagaacaagactccatctc

SEQ ID NO: 8014 - DNA, 448 bp, Homo sapiens
ctgttttgtcctcattaacctctaatgcttgtctttcatatttctttactgtcatatgatatagcagaatagagttattgatttcaatggtgcaaaatattttgattactaaaaaataccattttcccctgatgaattgactgatgttttaaaaatccatccaacaagtaactgttgaatcctataatatagattgctttgttaaggcaaatggtgaatgcaaaatagtgaacactataatctctggaaaccaaataaaaagacttcggctctcagaagtatacagcaactacatattttaccaccaaccacatgcccaaccaatggtatatacaaattaactattcttataatgaaaaaccttatcccaatcataaatgcgtctccattcggaataaaaataactgtaacatttgaaaaggaaagctttgtcacaaaacaatgacct

SEQ ID NO: 8015 - DNA, 353 bp, Homo sapiens
tgctgtcgtcttggagctttcatttactaatgaggaacaaatgatagtcatgttatgacaatgtgttataaattaacaatcctcttttaaactagatttataaaacctacacacttgagggtttccatttgttctatctagatgtattttgagaaatctgaaacaaaagcttgtttttttgtttgtttgtttgttgtttgaaacagtcttgctctgtcacccagcctggagtgcagtggtgcgatcttggctcactgttaactcggcctcccagattcaagcgattctcctgcctcagcctcctgataagctgggattgcaggcgcgcatcaccacgcccaacataatgaaac

SEQ ID NO: 8016 - DNA, 319 bp, Homo sapiens
cattatgtctacggaggagtgtctctgttatatcagtaggaaatcaaggtggctttttcagagactgtgttggttcctttcaaatatttggaaacactgacagaaggagacattttagatttcctcaaagtttacactgcccatttttggggggaggcatgcctagtttctttgaaactggctatgttttccttaatacctgatttgcctttctctgtaatccttaaaataaaatttgttaaaagtgttcttcattatggaaacaatatatatgtggtaaacagtatagaatggcatacctcattcatacttctccttc

SEQ ID NO: 8017 - DNA, 299 bp, Homo sapiens
aattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagaaaactctttttctcccttgtacttttttttgacctggcatctttttatagggaaaaatggcctttgtaggcagtggaaaacttgcaaggaaagctgccg

SEQ ID NO: 8018 - DNA, 161 bp, Homo sapiens
tgggaaaacgtgactcgggttcctctagagaagcagtggcagatgagagtacaaaggcaatggggagctggaggaaggccttaagcaggggcggcggcatggtaaggtttgtaggaagactggctgcagcagaagcagggagaccagtgtggagtctgctc

SEQ ID NO: 8019 - DNA, 174 bp, Homo sapiens
gtagtgttttcccctggtttatacctcttcttctagtttaacttttactggtcctaagcatttgtcactcaaaaaataccattttatggtgttgggaaaactggctagccgcatgcagaaaactgaaactggaccccttccttacactttatacaaaaattaactcatgatgga

SEQ ID NO: 8020 - DNA, 214 bp, Homo sapiens
agatgcctgctatcctgactaatttaagtcattgctgactgcatagctctttttcttgagaggctctccattttgattcagaaagttagcatatttattaccaatgaatttgaaaccagggcttttttttttttgggggaatgaaaacccacccccttgcccccaaataattaaaaatgcccccttggttttttttttaaggaaacccctttta

SEQ ID NO: 8021 - DNA, 437 bp, Homo sapiens
tgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagagtggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttga

SEQ ID NO: 8022 - DNA, 325 bp, Homo sapiens
gaaggtgtgattttttcaggagctggaagtcttaaaaaagccttgtaaatgcctatattgtgggcttttaacgtatttaagggaccacttaagacgagattaaatgggctcttctggatttgttcctcatttgtcacaggtgtcttgtgattgaaaatcatgagcgaagtgaaattgcattgaatttcaagggaatttagtatgtaaatcgtgccttaaaaacacatctgttgtcttttctgtgtttggtcgatattaataatggcaaaatttttgcctatctagtatcttcaaattgtagtctttgtaacaaccaaataacctt

SEQ ID NO: 8023 - DNA, 269 bp, Homo sapiens
atggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtctttttttttttaccaaaactagttacattggaatgcttact

SEQ ID NO: 8024 - DNA, 289 bp, Homo sapiens
tcacaatgctttatatttttcagagaatatttgcattcattacatcaactgcaattcatagggattctgtgagctgatatgtcattacattacttctcaggtgaataatttagtggacttattaaaaattagaaaaaattagaaaccaggcatggtggctcatgcctgtaatcccagcactttgggaggctgaggcgggtggttcacctgaggtcaggagttcgagactagcctggccaacatgatgaaaccccatctatactaaaaatacaaaaattagctgggtgtg

SEQ ID NO: 8025 - DNA, 413 bp, Homo sapiens
ccgttgctgtcgaaagaatccacactgcccaggtcggggagcagtggtggccagcagccctcagggatgatagagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctc

SEQ ID NO: 8026 - DNA, 358 bp, Homo sapiens
gtattgactgaactaccagatattgaggcttctttgcttattagctgcatgactttgggcaagtcaagttccacctgagccttgcaagtcaggcctggggagtccaaccacccagaacctttgagtctctgttagagagcaagaccctctcttaagaaacaaaaataaaacaaaaaaagagtattgggatatggggagtttggctcctgtagaaagggtagtctgggaggcctgttagaggagttaacattggacctgagacctgaggatgaacagaagccatcctgaaagaactgggaaaataaagaggtggccaggcgtggtggcgcacgcctgtaatcccatcactttgggaagc

SEQ ID NO: 8027 - DNA, 311 bp, Homo sapiens
acagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaaca

SEQ ID NO: 8028 - DNA, 524 bp, Homo sapiens
ggtcataagaaaaaatacttgctaaatatttgaaagaacagctacaatatctctcagtgggaaaaatagaggcagaaagctagtggcaaaatctctgagtgactgtttcccattcttaacccagtatcaaatatgctatggaatcagcactacagagaagctgatataatgggaggcagaatgccattacaccctttttttcccctcaggatcttagaatcagtcaccggtggttttgcaaaaactactactaacaacaacaacattttaaaaaagaaacctcatcttcagagaaagcactggctaaccggtctccattttcagttgctgggataaagaacctatgtgggccaggcgcagtggctcatgcctgtaatcccagcactttgggaggctgaggcaggcagatcacttgaggccaggagttcgagaccagcctggccaacatggcgaaaccctgttgctactgaaaatacaaaattttagccaggcatggtggcatgcgcctgtagtccctactgctc

SEQ ID NO: 8029 - DNA, 574 bp, Homo sapiens
ttttcaacgagaacttattcatctatccaacattcttcatccattcaacactcataaatatttagtgggcattcacaatattccaagttcaaacttgactttcagtgagttcacagataacggtttccaggtggctaaatttgacacatctgggagtcaggcaacaggaattcaggttaaagaaaacaaagagaaagatcagatacttgggcagatagtgaagccagtgagagaacctgggccctcaggcccctggatccatcctctgcagagaggtgctcaatcctttgcagctttgcagagaggtgctcaatctaaattcaggaaaacaaactctcctatcacagatagggaaattgaggctgatcaaactcttgtacaattttgtttattccatagcccctatgtcaccctatcaccgtattaccacttctatctttgtaagtttctactgaaaccccttatcttagtacaaaaaggcttccaagaatacaaaaattagccaagtgtggtggcaggcgcctgtaatcccagctactcaggaggccgaggaaggagaatcaattgaacctgg

SEQ ID NO: 8030 - DNA, 398 bp, Homo sapiens
atacaagaacagctggatttggcccgtgggccctaacttcccgaaagcccctggttaatgtagcctgccccttgtttcccactctatataactataggactccagcccggcacggtggcttacgcctgtcatcccagcactttgggaggccgaggcgggcggatcacctgaggtcaggagttcgaaaccagcctgaccaacatggagaaaccccgtctctactaaaaatacaaaattagcctggcgtggtggtgcatgcctgtaatcccagctacttgggaggccgagggaggagaattgcttgaaatctgggaggcagaggttgtggtgagccgagatcatgccattgcactccagcctgggcaacaagagcgaaactctatctcaaaaacagcaag

SEQ ID NO: 8031 - DNA, 418 bp, Homo sapiens
cagatcacctacaggagagatggccacaccaggaacctgtttgtgtatcatgaaagtgggaaggtgagatgcctggagttgccacctccgcctccagctcgcaccccaggacttggcaggtgcagctcaccacctcccctgctcactggtgctgtgctcagctgcctcttgagattttctgctaccatttgccttaatctatcattgcctcccagtctgagataaagatatgaggagggcagggtgagatcagggagaggaacctggcaagtaccatggctatatctggacagtgcacagccaccaatgaaagtccagttacagaagggactatgcccagggatgcaaagccaggtagggccagaggttctgaatacgggggaggaactgatggacagtcaggcagcagtgcaccccg

SEQ ID NO: 8032 - DNA, 561 bp, Homo sapiens
gtgtatccaggtaaaaagggcattttgcagtcttcctcgctgtttatgatggccaggtaattcagttctcttcagtgcagatgtctcctggggactttttgggaaaagtagtaatctcatatctgtgtgaaaaggcaacacatccagcccaaagtgtatgctatcagtctcacttgtagttaagggtggctgtgaaatacaattctgtcaatttggacatatcacacttctcctgggtatctgagaaaaatttgcctttcctgacatggacaccccttcttccttactatatccagcttatttctactcaaagtgtgccatagcttgggtaactcgggcagcagactctgcgactgagattagtatgcagagagcttgttaggagttctcataggatcaaaacttgaggagcaaagaaaggagagtatgattgggcacaggagggaagaggagaggtaatgcagtgtgaacagaaagttcagacaaagctacagggcgctctcgagataagatgacccttcagtattattccatgttgcacaaaaaagactgatctctatg

SEQ ID NO: 8033 - DNA, 559 bp, Homo sapiens
tggtcttcactatttttaaaccatctcagctaaatcttttatgttattgtatttttaattctggtttgatccctggaggtgaaggctacagtgaaccatgattacaccactgcatctcagcctgggtgacagagcaagaccctgtctttttataaagagagaaagtgagagaaaaagagaaagagaaagagagaaagaaaaaggaaagaaagaaagagagaaaagaaagcaagaaagagagagaaagaaagaaaagaaagctgtgaagatgatacttgttaaccagaatgaaagctcatttggtcagtagattaaatacaaataataattctatcattatgtctcaggcagtgtgctataagtgattattacgtgtcatcttatttcatccttacagtaatctgttttgggtaaattttaggataatttctggctgggtgcggtggcttacgcctgtaatcccagcactttgggaggccgagacaggcggatcacctgaggtcaggagtttgagaccaggctggccaacatggtgaaatcctgtctctactaaaaatac

SEQ ID NO: 8034 - DNA, 331 bp, Homo sapiens
  misc_feature 331: n = A,T,C or G
gcactacacatagttatttctgaaaagaaatcagtatgtaaatagaaatccaacagaaatgataggtgtactatcaattctttattgttgggttcgaaagcaatcacttgaggttaaaagataattttaaaatattaatattctcatatttactattttggtcccaatgcatgtgtataccaaaatagtaatatgtagcacacatgatttaattgctcttttcaaaaacacttaaaaggaatctatgtttaaagaatattcacataatcatacaggcatggtggctcactcctgtaatcccagcactttgggaggccgaagtgggtggatn

SEQ ID NO: 8035 - DNA, 451 bp, Homo sapiens
taagatcttatggacttacatgcatagaaagtaaataaaatgtagtcgcttccttctcactcttctgtgctttcccacacgctgctccttcccttggaaacaccccttctctgcctcaccacagtaactctactcatctcaaaaactcactttaaacatttactgcttccaaggctctttgcttctaacccagcatttgatatggtattattggatggtaatatttttcccatctaaacaaagagctccttgagggcaggggttgtatcttttgtttctatatcctcaaccctaagataaattgcgtataaagcaagaatttgcatgtaaaatatttctttagcttcatgttttactgaaagttcaacctccaacatgcaacaaaaattgctattaaaactcacactgcccatctgaaaaaattttccaacatttatttatttaaaatcta

SEQ ID NO: 8036 - DNA, 55 bp, Homo sapiens
cctacggttgcgatgagacgacacaacggaatgcacttttacatgatgccaactc

SEQ ID NO: 8037 - DNA, 68 bp, Homo sapiens
ggactatgagaatcgaacccatccctgagaatccaaaattctccgtgccacctatcacaccccatccg

SEQ ID NO: 8038 - DNA, 352 bp, Homo sapiens
atagatgagaggtaatgtctttacatgggaacaatccaataaagtcctacaataatatagggcaataaattttggagagctttaattactgtgcaagaaaaatattctagttgaaatgaagagtctccttggcctgtttccgcacagcagagcaaaccgtcttctccattcacatttcttggagttaagagcctggcctaggctgggcgtggtggctcacacctgtaattccaacactttggggggccaaagtgggtggatcacctgaagtcaggagtttgatatatcactgggcaatacaatgaaacactgtgtctacaatatattcaagaattatccacgtgtgggtacg

SEQ ID NO: 8039 - DNA, 187 bp, Homo sapiens
cactgctttgtaagtcttttcttattttttcatatgtacatttgacttttccagctaggctgtaagttccctaagggcagggtgcatattttccatatgttttggcacctatactaggcctgggtatatagtaggcaattaataatatttgttaaggctgggtgtggtggcttatgccagtaatcat

SEQ ID NO: 8040 - DNA, 470 bp, Homo sapiens
tgaggattgcaagtaagtgttaatagggcagacctccaaaatgagccagatacaaaggtatttggcagaggaaaaataattcactaacttgaaatagcagataagcaaccaatggagttagaatcaaatgccattatttgagaaaggcgttcagtaaaattccttcatacaaattaacaaatatttatgcagaaactcctatgtgaaaaacattgtgccaggctcagttatgggagtggggtggggaggggaacatgaagataaataagacaatttcttttctcaaggaaatgaccacataattggagatattggccaataaactataatgcaacacaaagaagttagttaagatagattaagaagagggagaaacatcatctgcatgaaaagtagggtggctatcagtgagaatggagagagaagatattcagatattcaagatattcaaatatatgaggcaaaataca

SEQ ID NO: 8041 - DNA, 453 bp, Homo sapiens
ggcacgagggtgggcaggcagctgcacctcattcctgagaccatccggggcagggcttttctgactgagacacacgaccctgacaccagagagaattctgtatttccccacccttgcaggggctgcccctagagaatcccatcgggtgagcccaggaacccacaagttctgcacccctcggatgggtaggcattttgagggcatgaggtaggcgttacagtgataagatacacagggctctaaaccacagaggccccggttcaaatcctgcctcttctaagtacaaattagttggctttgggaagtgagtcaactttgccccgggctgcagtttcctcgctgtcaaatgcatgggagagggtgtgtgaagagttaaaatgtatttagatttcactgtagtgtctcctccaacatgatctcacactccttttacagtataagcaggctgatgtc

SEQ ID NO: 8042 - DNA, 527 bp, Homo sapiens
atgttcactttatgaaaggaagtaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaagggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcat

SEQ ID NO: 8043 - DNA, 364 bp, Homo sapiens
cagccccccagtttttatgtggacatgttttcatctctcttggatatatacctaggagtggaattgcttggttgtgtggcaattctatgtttagcattcgaagaaattcattgaatggtaagctgaaaagtgacgtggttgaatttctgatttcagaaagatcactgatgtgatgagaatgaataactctctggagtgctaagatgtgggggcagggagctagcttagtatattattgcaaaatcttgccaaagatgagctgatcaaatgagaggaagcatgaactaagaagggagcagcaggagtggaaaagagagatataatgatgctagtacagagtttatatttacagaacttgaaatgc

SEQ ID NO: 8044 - DNA, 610 bp, Homo sapiens
agattataccaaaaaaatgcgatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtggttttttaagtagttaatgtatagcaaaattagtttcacattgtcaagttttcaatacatccccaagttaaattgattttaaattaatgatcaata

SEQ ID NO: 8045 - DNA, 491 bp, Homo sapiens
ggcacgagccactgctacagccttagtccagactttctctttctttaatctaggctgttaatatagcctaataaatgttccgggccctccagtctatttgtcattcaatcacttgtttcagaaatattactaggcacttattttatgccatggcacaattctaggtgctgaagacgacacagctgcgaataaaacagacatgggacctgttcttgtggagcttatactttagtgcgtagagaaactaaacagagaggtatgaaagatagtgatgggacataattctactgaaggttgggtgatcaaagaagctttgctgaagagatttgtgttgatgttggtattttctaaaaacagatgaccaatatggttaaatttggttctgagggagaaggtaacatgagatgagctcagataattagacaggggccagatcatttatatgcaaattagattatgagataacagaatggtatatttccctcatccta

SEQ ID NO: 8046 - DNA, 601 bp, Homo sapiens
gacattgtgattgcaaaaagcccaagtgatccacaatcaaatgtatgactgtgacaataactgggaatgaatcaatgaaattgttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgc

SEQ ID NO: 8047 - DNA, 473 bp, Homo sapiens
  misc_feature 193: n = A,T,C or G
ggcacgagcattagtgtaagtgcaggtaattgcttcattaggacatatgtattgaaggagggagggcaagtctatagcatggtgataaaaacaggcctcaccctctttctctacccacacaggagcatctcagcttgacttcagggatccaggagccaccagccaccctgtaaacagcccagattaatcctgngtttcagtgtcatgggaggaaggaaggatgacctagtaaagagcaacttacttactttctttggggtggtaactcattgctgaactctggatggcactggtgcgttcaaggcaatgtgattgaatcattggggattattactgaattagggagcaaagtattcttatggaagctgtatgctttctgaggctcaccaggccggatggcatgagccctatcctctgtttgagttatttgactggctttttaagggagtctccattttcattctggccatgac

SEQ ID NO: 8048 - DNA, 300 bp, Homo sapiens
ttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtactttttttttgagagggagtttcactcttgttgcccaggctggagtgcaatggcacgatcttggctcactgcaacctctgcctcctgggttcaagcaattctcctgcct

SEQ ID NO: 8049 - DNA, 515 bp, Homo sapiens
ggcacgagcaagaattgctgctgctgttttttttttaattttattttttatttttaaagactttcctaccttctcattgagagagagaaagatgcccagagttaaaataggaggtgcttgggtattttgttgaacttcacaagttaaactggcgaatggcgtccatcagctgttattcagtccttgaacagagcagatatgtttgtgcgaggacaaagaagatgcctcaaagacaaagaagaagatgcctcgtcgtcccctgagctcccacacggcatctgcacatcaccagctcagcatttagcacactggattgacactgccatgttaggtgaggtgacggcatgccctagagtgaaggaatctacagcaatatgatagctaaatgccacatgaagttctggattggatcctggattgggaaaaaacatggctctaaagggcagtattgggacaattggtgaaatttaaatgtagtctatgtattaggggataatgctgttatcaattataca

SEQ ID NO: 8050 - DNA, 561 bp, Homo sapiens
ggcacgagcctaggcgtagtcatttctttattagtccttactttatttttcaaagttacgtaataaatgtctatgtttctaagctatctttagatttgtaaaagggctaaaatgttacttttaaacatgtttggtttattcaaatttgtttataaatctctcctttgtacccctggctaccacccctccccactcctctgcctaaaactaagggaaaatcctgtctttgcccatagcttcagaatgttctgcaattttagacttttacttttaactgatcactgttaagcaagggaggaaatttaccacttctctttgtgatgtaatattgcacagtgaccctaagtggaagccttcctgtgtcctggatgtgagctctgcgctgtcagtggttggcttgtaagctctggctccaagtgttctgaggtgcaaggaaccgatcttgtgcagtagaaagagcttttggaagttggcaagtagcaaggctagttctcatacattctatgctctggccacctttttctgtggcaggaaaacaaaacaggcaaatgcacacaaact

SEQ ID NO: 8051 - DNA, 559 bp, Homo sapiens
cgaggtgcgtctagaggaaatgtactgttttgcagataataagtattgatcagacatgcatttttacctctgctgtgggattttagtctcattactttgttgatctactttgtagttaacctagagaagttaacacagccattgctacagagctttctgccacttgagttccagaattccagaatccagtttcctagggattgtggggagtaaaaagaggtatagggtatggtccctgtatgggagcaatacagtctttattgagtagtgtctatattgtcttgtttactcaggtatttcatatatacattaaaaaaaccgacaataaaaatgaacatatgaaaacttccttatttgtgatacatgagtaaatgttgatgagattagagaaggggtccaaaaaggtttctctgaggatatgagttgagttgcccatcaggatggattgggtagtggatgctgatgtgggcaaacactggaatagacctcagatgctgcatgatgtgcctgtgtaacacagttgaaatttggtgatcaagggacatattacagcagggta

SEQ ID NO: 8052 - DNA, 124 bp, Homo sapiens
gaatttgaggctgcagtgaactggaacggtgtcactgtacttcagcctggtgacatagcgagttgctgtgtcaaacaccatcaccaccaccagcaccaagaacaatatcaacaaaacttggctg

SEQ ID NO: 8053 - DNA, 327 bp, Homo sapiens
gctggagtgcaatggtgcaatctccactcactgcaacctctgccttctgggctctgctccatctcctgcttcagcctcctgagtaactgggactcagtcatgagccaccatgcccggctaattgtttttgtatttttagtagagacggggtttctctatgttggccaggctggtctcaaactcctgcctgaagtggtctgccagccctggcctcccaaagtgctggggttacaggcatgagccaccatgcccagccacattaactttttaaataagacaaatgtgcccataataattacatttattccaaattgtgttagttgtcct

SEQ ID NO: 8054 - DNA, 561 bp, Homo sapiens
tccttacccttcgagcagactgtgcaactttccagtcattcttactttccaacattaaaaaatctaagctagtcatatgttcttccaatttaaatcttctttctcccaactcagacctgatctcgtttcaagattctccggaggagaagggaaacaaggactattcttttagtatttatctcctccaacaacctgagatttaggcagttctcttgaggtttctttactgggcttgaggtaagggaaggagtttcagtctcttttcctgataattcttgccatttggatgatacagtaaagatttcagaatcagtttgcatccactttggcaattctttcataggtaatctaaaacctctttttggaataaagaaaaattatcacctattgttattagttttaggacattaactcagaccagaaaaatgtcctatttaataatttgttatacatattttaaattttaacagatattaataaatagtagtagtttaacaaattttcacttccactaaaattatatcaaacacaatttatcctcatccaaattttgaatctttg

SEQ ID NO: 8055 - DNA, 56 bp, Homo sapiens
catggtatgtgtggccaggggcagggctcatgcctataatcccagcacattgagag

SEQ ID NO: 8056 - DNA, 634 bp, Homo sapiens
tgacaactgagcttaaactaattaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccagagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctccttggctttaattatgctaatgttggaggagaatgaataaataaag

SEQ ID NO: 8057 - DNA, 398 bp, Homo sapiens
ttatggttccagtaagtggtgctataattgctggctttaatgattcattcattcaggaaatcagcaagatgtatccaggtaaataaataagttgcttttcagaaaaagtagctaacaaacatatttctatttgtacataggctattgtagtaaatcttaatttccaaagctacccccccaccacagtcttaatgtaacttatccttcttatttcaggaagagcttcagcttcaccttctttagatgtccttattactttattgtcacttggatcaaatggctataagaagctactaaaagaaagaaaggtaagctttccctttaagtgtcgaataacattcttgactagaactgtgctccaaatcattggtgttttctgcctgttggtttcttgcatt

SEQ ID NO: 8058 - DNA, 442 bp, Homo sapiens
ggaggaggaggaaggtcaggggttatgggaggcaaccctctgactttggttggagctatttctccagcgcccagggaacccccagccttctcatggaggcattattcaggccactctcctttagccacacttctggccactgtgggttgccacaagtacctcaaagacagggactgggccctcaggaagatggccccagtgttcccagtctcactcagtcagggtctatttcacgaattaccatcatatcaggaaaccttttgtactgtactaatgcaatatacgtttttgttagctcactttgaactttaaatttacttaaaaggaaactttatttcactaccatcccaaggaactatatccatgaaatcactggtttgaccttctaattggggctttttctaatccttatgaaaataaaggtattttaaaaaaaaaaaaa

SEQ ID NO: 8059 - DNA, 540 bp, Homo sapiens
caaatcttctatatcttcacttattttctgcttacttgtaatctctatctataattacatatttatctatttctccttgaaattatatagattttgtgttatgtatagctgttattagatatataaatatttaggatcattatctcctcttcatgatttcacacttattatgaaatatctcctttatccatggtaataatctttgctctaagatctactttgatatttatatggtcactccaaacttcttttgatcgatgctagcatgatgtgcataccttttttccatcctttacttttaatttgcttgtgtctttatattgaaagtgtgttcttataggcataaacaagaccttatacttttatccaatctgataatagtctttgtcttataattggagcatttagaccaatcatctttaatgtaattgtctatttaaagttgcaccttaactccatgctgtccaccacaactccatcctttccacctcagcccaaatactcccaatgccattttctgcttgattttgacttttgctc

SEQ ID NO: 8060 - DNA, 461 bp, Homo sapiens
ctgttgcccaggctgtagtgcggtggtgcaatctcggctcactgcaacctctgcctcccaggttcaagcgattctcctgcctcagcctcctaagtagctgggaaaggaacgcgccaccgtgcctggctaatttttgtacttttagtggaggtggggtttcaccatattggccaggctggtctcaaactcctgacctcaagtgatccgcctatcttggcctcccaaaagtgcagggattacgggtgtgatccaccatacccggcctatttatttcttaatgaaatgaaatcatgtttctaaggactacttataaaatcttataatcaaagtaataacaacctggacaacatagcaagaccccatctctacaagaaattaaaaaattaaaggccgggtgtgatggttcacaccggtaatcctagcactttgagagaccaaggcaggaggatcacttgagctca

SEQ ID NO: 8061 - DNA, 635 bp, Homo sapiens
aaatatactaaaaagagatacttaaaaagatgaattttcctttctatattaattacaatggatttttagataatatggaaatatataaaagtagtcagtgtttagacatttgaaaaattaatgggaatatatattttgctgtatggttctgaaagtactaattggtaattgaatcataaaatatcagagttgagattaaagagctaaaattaaataatatcttcagagacttaacagagatctttcatttgtgccaaatttagtaagatttgcctcaattcagttttacttatggtgtatattgattctttaaaatgtcacgtgtatggtggctcatgcctgtaatcccagcactttgggaggccaaggcgggcagatcatgaggtcaggagatatagaccatcctgcctaacatggtgaaaccctgtctctactaaaaatacaaaaaaaggcccggcacagtggctcatgcctgtaatcccagcactttgggaggccgaggtgggtggatcacctgaggtcaggagtttgagaccagcctggccaacatggcgaaaccccatctctactaaaaatacaaaaattagccagacatggtggcaagcacctataatcccagctacttgggaggctga

SEQ ID NO: 8062 - DNA, 487 bp, Homo sapiens
tgtactgtaggacattagcagtatctctggctatgaaggcactagttgccagtagcgcacacacccccacccacccaatgagacaataaaaaatgcctccagacattgccaaatgtctcctgggggtggagggaaatccctagaaataaccgaaattggctttttttccctttcttttttgctgtcataagcctttataattctacagaatcttttggccaaacccataagtgaactgtgtgtgacttaattgtcttttattacaacttcatgtgaaatcagtgttcatttcctattaatactggcaacagattcaacagcttaatcacatacaagattatttctatatattcttacaaaaaaatttgtcataaattgcttctgccaaaacacatgaccaaattttcaagtttcatgaaaccatacagacataaatccatgcaagacgaaagcacatagaagaaacgactaccacatacaaagcgtc

SEQ ID NO: 8063 - DNA, 543 bp, Homo sapiens
cacagaacaaagtagcaaaaccctaaaagagtttgttggtatactcctccaacttctgctaacagcagagcttctaactagcctgaattagggagttaaccgggctgacaaactacaatattcctctgttattgatggtttttctttccaaagtttcagttaactatggccaactgcagtctgaaaatattaaatggaaaattccagaaatagacagtttgtaagttttaaataactgttatcaccatatgttgttataattgttctattttataattagttattatgtttccttcattatcgtgcctaatttataaatgaaacttcatcataggtatgtataggaaacaaagcacagtatatatagggtttggtgccatacacagctgcaggaatctgcagaatgtcttggattgtaccacccatggataagggggactagtgtatagccctccgggaggctaagcagtagctcagcacatcttaagccttctcctctcctgtggttcacctgtgatatatccagatctacccattctttct

SEQ ID NO: 8064 - DNA, 490 bp, Homo sapiens
acgacagaagggcagcagtttctgttgtgctccaagaactgtgttatcaggacccaccactcagaatactccagttttatcacatactccgcctctgggccgtagtagaggaggcagtaattatctatcacatgcttgcacccagcatttgctcttcctatctgatcaacttagagcttaagaaaaaaattatatatatatgtatatataaaatttttgggccgggggcggtggctcacgcctgcaatcccagcactttgggaggctgatgcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgtactccagcctgggcgacagagcaag

SEQ ID NO: 8065 - DNA, 384 bp, Homo sapiens
cagaaacaagaatgtggccctttcacagcccgtctggctcatctgaaagcttcagagaagcagccactttccgaggcagctgtacctaccccgcagagggctattctgcctgggaagttggcagaggcctttgcaaaccagtggctccagcctggggcccagacagggatggggagggctagttctgcacccagctccgtggcctctgcttcctcccaggtaccaggaggtccaggcggcccaaaaagcactgaggacggctgtggcagaagtgctgcctgaagcggaaagcgtgttggccaccgtgcagcaagttggcgcaaatacagccccgtacctggccttgctggcttccccgggagctctggtcagctcagttgtctc

SEQ ID NO: 8066 - DNA, 630 bp, Homo sapiens
ctgggatctcagctggagagaaggacatcagggtgaccatatccaccacgggccgggagctgcagggcagaaggcaaccaactctctccctccaacccaactgcacgtcccccctcagatgtggggctcccgccagcaaagccagagaactctccttccctaaagcagacctcaacatgtcactgtctcctcttaaggaaaataataatgatactttttatttatttattttgagagagggtctcaccctgttgcccaggctggagtgcagtggcatgataacagctcactacagcctcggcctcccaggctctagtaatcctcccacctcagcctcccaaggatctgggaccacaggcatgtgccaccacacctggctaactttaaataaatttttgtagagaagggaccttcctatgttgtccagggtggtcttgaactcctgagctcaagcaatcctcccagcttgggctcccaaagtgctgggattataggcatgagccaccatgcctggccaataatggtgataactaattagggctcccagttcattctagcagcctctgacccattttccatgaagaagagaaagctcttaggaagagaaatcatactgagttactttcatgc

SEQ ID NO: 8067 - DNA, 105 bp, Homo sapiens
gaaagccttcattaatgtcttttaaactacttcctctactctctatacttgtaacttcccaaggtagcttaacataagggtctttaaagctacttccactcaagt

SEQ ID NO: 8068 - DNA, 433 bp, Homo sapiens
gagactggagggaaggaggagtacatttaaaaaatcattttccgggctcccttcctgtggagtccccgtgggctggccacagcccttgacccagcctcagctccgtcagtaaatctctccaggtcccctgtctgcaccgcttcaaatttagggtggcaacagtccccagtgttcctagccccagggtactaaatcattccttccctgttgcttttcttaatccctgtttatacctttgtaaataatctcattgctaaactctcctcaattactcaacttgagtgtgtcatctgtttcctgctggtactggaatgatacctatggagtctggaaatacttctccacccagagaaaaaacaacagctcacatgcacctgcaaataggacttcagtgcgtctcagattcctgaggcggtagggaagggtagagagt

SEQ ID NO: 8069 - DNA, 590 bp, Homo sapiens
tcgtgaacaccctagacctgagaggaggaccagcccagatgaaagcttggaagaattcccaggggctggtggcagtctcagcctggctgctctgcccagggacatggcccacagggctctgctttccctgctgccagctcctcagctggagacagcatggccagtggaggcctcctgtggctgcttctctcagaccaaactcctttgagaaattttgacatgaatgagaatagggtagcctaattgaaatacaatggggtcttcctcctaaattcccacctctaagctagttttctcttgggagggactagtgctctctttttaagaggggtgtgtgtgagtgagtgagtgagtgtgtgtatgcgcacacataggttaacagtttggttctaatttagttgcctgtcccaactgcattgtttactggtagtggtaactttacttcatcatataacctgctcttcacagtggcttcaaaatgcattgtaactcatcactggtactaccatgccctcagacatcatgaagacagactgagggcagggctgggactatgtgtgtacacgtgcgtgcctgtgtgtgccctcaca

SEQ ID NO: 8070 - DNA, 541 bp, Homo sapiens
aactaaaatatgtgagatgatggcaaggtgggcagaaggaaagttcaggaactatggacacaagactgtgggccctatgctacggtcaaagccaacgggttctctgaatacccaaaagctggttctctctctggctgcattctacaatcaccttaggagcttcaaacaacaccaattcctacgtgccctccagactgaatgatcagaacctgaaggtacagcccaggcaccggcactttaaaagagctccccagaagattctaatgtttagcgagaattgacagtactgtcccagtgggtcaatatctccctagcttaagacataccaggcgggatgtggtggctcacgcctgtaatcccagtgctttgggagaccaaggtgggcggatcacttcaggccaggagttcaagaccagcctggccaacatgatgaaaccctgtctcgactaaaagtacaggcttgggtgcggtggttcacgccagtaatcccagcactttggaaggccgaagcgggcagatcacctgaggtcagatgtttgtg

SEQ ID NO: 8071 - DNA, 616 bp, Homo sapiens
aaatacaaagtaaaccggcaaactactttcatttgatgaatatcagtgtgtacattctacatgaaagaataatgcagagaatcgggcaaaagaccaaaagaataattatccatgaataaatgatgtatattccaaaaatgcaaagatagtttgactctattaattggccatatcagatgaaaagagaacctccataaatatctatcagatattaaaacatattacaaagctatggcaattaatacattacggtaccaaatcaaaaataagtttatcaggctggacacagtggttcacgcctgtaatcccatcaatttgggaggctgaggtgggtggatcaactgaggtcaggagtttgagtccagcctggccaacatgatgaaaccgggtctctactaaaaatacaaaaattagctgggcatggtggcacatgccctataatcccagctacttgggaggctgaggtacgagaatcgcttgagcccagaaggcagagcttgcagtgagccgagattgtgtcactgcactccagcctgggcaaaagtgagactctgactcaaacaaacaaaaaagaataagtgtatcaataaaacagagtatagaatccacaaatata

SEQ ID NO: 8072 - DNA, 517 bp, Homo sapiens
caatttcttgctattaattaataataattataacgatagataagtgcttatgaggtgccgggtactgttctgaacactttacatatgtcatttacatgtattgatcatttaattatcacagctaagccatgaggtaggtaatattactgttctcactttaaatgcaatgaaactgaggtatggaaagtttatgtaagttaaataagaaccatttatagagaaataaagttttgcctatagtaaaagatgaaataagccaggcatggtggcatgcacctatagtcccagctactcaggaggctgaggtaggaggattgcttgagctcagaagtttgagaccagcctagccaacatagcaaaaccctgcatcaaaaaaaaaaatggaataggccgggttgcggtggctcacacctataatatcagcactttgggaggccaaggcaggtggatcacttgaggtcaggagctcaagaccaacctggccaacatggtgaaaccctgtctctaccaaaaatac

SEQ ID NO: 8073 - DNA, 571 bp, Homo sapiens
tgctcactttagaagtgcttgccctttcatcccttgcaggatggagagaaggaacactagtgatgagaactgactcatttctgggcacatgctgcctgccaggctccacactgcgtgttgtacagaaatgatctcatttagttcttccaactgctctctgaggtagatacgacttttatctctccacttaaagatgaggaaaattctccaaggtcagacagctagtaagaggcagtgcctgggtttgaacccaggtccacctgacttcgaatctgggcatatgtgaaccttggttacacactagaaagggcgcccgtgtgtgctcatgcaagccatcctctccttgggtcctggggaatcccgaagtcttctccattcaaaacgactcagtgttccctgggagagccagaaatgtctttagagagaagctagaacattctttagagataagtcctatctctcctgtttatttctaaaacatgtcatttgaaaatgggagaagggtcaccttttcccctgcagctgacatgctgaataccatctctaaccctatttgtttctgaagaaactt

SEQ ID NO: 8074 - DNA, 611 bp, Homo sapiens
aacgcaagatgataccaggaaggcagattgggagtgagtttctagtggactctggatgccaagctaaagatgaggactttattttgtgggcaataagaaaccagaggaggcttctggatagagaagcgtagaacaagatgtgatgaggacagggatccagggagaagggctcggtgtcagggatatgcagaatggcaatggggaggggtcccagaagcaggagatggcccagcagaagaatgaaagacacagctggaaaaacacagtggaaagaattacacacccagagaaggagaggccacaaagcagacatggacacagacatacgccaaacaattgtcagctgacatgcctgttgcctcctttgggggccaatgaccttctcttacttgtccttcatacctgcacctagctcagtgtctgtttgagtagacactcaatccattctcgacaaatgaatgaactaatgaattccacatcctgaaaggtggagggaaagggagttaaagcttcaacatggtattaaacagggcagcaagacccagtctctacacaaaattaaaaaattagccaggcatggtggcacacacctgcagtgccagttacttgaa

SEQ ID NO: 8075 - DNA, 511 bp, Homo sapiens
attaggccaggcacggtggttcacacctataatcccagcactttgggagaccatggcgagtggatcagttgaggccaggagtttgagaccagcctggccaacatggtgaaaccatgttgtctctactaaaaatacaaaaattagccaggtgtggtggcgtatgcctgtaatcccagctactcaggaggctgaggcacaggaatcacttgaacccagaaggcagaggttgcagtgagcagagattgtgcctctgcactccaacctgggtgacagagtgacaccttgtcaaaagaaagaaagaaacaaacaaacaaagaaggaaggaaggaaggagagagaaagagagagagagaaagagagagagagaggaaggagaagaaacctcgaagactaaaattcaaggaaaaaaatttttaataggacagaattcaagaaataagaaatgattaatatcattaatatgtaatgattaatatgtagtaagaatataaataaagagaacaaagagaga

SEQ ID NO: 8076 - DNA, 459 bp, Homo sapiens
ttgatcagacactacctgtgagctctctttttcttagttctaataaggaaatagatactaagtcttagaaatttttaaatactttgggcacaacaacatttttttaaacaaagacctagagcaacatgttgctggactttctgagcaaagaaagtcaagtgatatagaaaactgactcctgggccaggggtggtgtctcacgcctgtaatcccagcactttggcaggccgaggtgggcagatcacgacatcaggagttcaagactagcctggccaatgtggtgaaacccatctctactaaaaatacaaaaattagccgggcatggtggcatgtgcctgtagtcccagctacttgggaggctgaggcagcagaattgcttggacccgggaggcgaaggttgcagtgagcagagattgtgccattatattccagcctgagcgatagagcaagactccgtct

SEQ ID NO: 8077 - DNA, 363 bp, Homo sapiens
atgaagggacagacacatagttcaatataacagaatacagaaatcataaatagacccacaaaaatataccaactgatttttgaggagagtgcaaaagcagctcagtggagaaaggatagtcttttctacaaaagaagctggaacaaaagaacatctgtatacaaaaataaacaaaccataacctaaaccttatacttcatgcaaaataaaatttaaaatagatcatggatagaaatgtaaaccacaaagctatacaacttttagaagaaaatataggataaaatctttataacttggggttaggcaaagtgttctccgatgtgacactttaaatgtgcagtatgctgcatttaaagaattgat

SEQ ID NO: 8078 - DNA, 109 bp, Homo sapiens
gctgcaagtagcagaacagtgactaaagcaatgaagtcataaagtatggagagctgatacacggagcatggtggaatggtgggttggaaaaagtttaggggccaggcac

SEQ ID NO: 8079 - DNA, 215 bp, Homo sapiens
catgcttggctaatttttgcatttttagtacagacgggtttcaccatgttggtcagggtggtcttgatctcttgacctcgtgatccacccgcctcggtctcccaaagtcctaagattacaggcatgatccactgtgcctggctaaacagcattactatacattctatatttacaaatttacaggtataacatgtcttgtatgatacatatacttg

SEQ ID NO: 8080 - DNA, 368 bp, Homo sapiens
taatagtaagaaaattattgaagtgtgtttttataaagaatgactacaacttttagagatttttgcttgttgatgtttaaaagctctttaatttttttgtgccctgctaatggactgtctttttagctgccccaaagtatctctgtttgattactaaagaaatcagtagaaaacttttattgtttacaaattgaagtctcagaaatagacaatgcaatataattttcattaataaagacctataattagagtgacaatgtaatttattgcccaatttgataaccttgagaatgggagattgttttacatatatatacacacacatatgtatatatgtacaaacgtgtgttcattacatatataaacac

SEQ ID NO: 8081 - DNA, 60 bp, Homo sapiens
catggctgtccaccggagcaagggggcgccctaatgctgtatattcttgccttgtacctc

SEQ ID NO: 8082 - DNA, 492 bp, Homo sapiens
caataagttttcattttaccaaagaattaaaggaaaaaagaagaaactagttactaattaaggaatagttagggaaattccatattgctgggagtgcaagtggtaaaaattctctggaaaatgatgttgcaatattaatccagatcttaaatatatttatatacgttaactagataattctccttctacagttttatcccatagaaaatattaaaaatgtggacaagatttatgtccaaagatttttttatctaaattctgtttaattcatggcaaatgtctgtatgttcaacaatagaatactatgtttaaaaaaattaaagtgtatttatgtgatgaactattatttcatggaacttgtttcctgtcatcagaattcatgggtacagacctaaatatactttataatctgtgagggtttgtgatcaggggaggatggtagcaaagattaaaatgaaatatataccaaaaacttaatagtaattatctctc

SEQ ID NO: 8083 - DNA, 584 bp, Homo sapiens
aatataatgagctaatgatgtgcaaatataaagggtcaggctggacagatttctttttttgccctggtatttagtatttcagactacataaattagtcaatacttctttgttgagtgaaaggatgaaagacacaagttctagcctgttgaattgttgttttctcttgggatgatctctcagttttccacttatttattttctctttctcacgatttgattctagttctgactatccaaatattatgttatgatttttgcaatggtcttttccattagttttctcactgagagagccaagtagtacccagctctagtcccattaagccatctttttaaaaaccccatttttaatatgttgccttcaaaaatacttacaaggtatgccagccttgagcttggcttccaggggtggcatcatgaggatgaaagagcagaattatctacacataggccaggcccggtggctcccgcctgtaatcccagcactttgggaggccaaggcaggcggatcacgaggttgggagatcgagaccatcctggctaacacggtgaaacccggtctctactaaaaatacaaaaaatt

SEQ ID NO: 8084 - DNA, 233 bp, Homo sapiens
tatgaacccaggaggtggaggttgcagtgagctgagattgtgccattgcactccagcctgggcaacaagagtgaaactctgtctcaaaaaaaaaagaaaaagagggagacgttaataacattaagcatgaaaagaaagagtttacacgaatacaacgaatacatacagatactgacaaaattagcattgaaagaacacctgggtaaaggtgaatttttttttttttttttttt

SEQ ID NO: 8085 - DNA, 411 bp, Homo sapiens
aggagagatacctatgataatggccgtcgcaccaacgtttgtcagaacataaaactggagataatctaaaaatctatcaacaggagaatggataaaaaatttgtggtatattcacataatggaatactaaaccaaggttaaaataaatgagctagaacttcaaagaatgccctatggtttgtatgtggcctctccataactcaggatttgaaacttgatggtcattgtgatggtattaagatggccattaagaagtgattacatcatggggcttctttgttcatgaattcctttatgaatgggattaacacccttataaaggagaccttttgcccttccaccttccaccatgtgacgacacaatgtttctcccctctggaggatgcagcaataaggcaccatcttggaagc

SEQ ID NO: 8086 - DNA, 129 bp, Homo sapiens
gcaagactcccatttataaagaaaagaataaactctgttcactatagttgcaagtcaagtatattttcttggttacatatttcttaagaaaagccctggccgggcacagtggctcacgcctgtaatccc

SEQ ID NO: 8087 - DNA, 526 bp, Homo sapiens
gcagtggtgtgatcatagttcactggaacctccaacaactgggcttaagccatcctcccaccttagcctcctcagtagctgggactacaggcatgcattgccacacctagctaacttttgaaatttttgtagagacggggtctcgccgtgtttcccaggctggtctcaaactcctgggctcaagcattccttccacctcagcctcccaagtgctgggattacaggcgtgagccacttggcctggctggtttacattttttaatgcccgtcttcagagtcaaaactgggattgccctggtgttagtttgcattaaaaattgctgatatgagatttatgcagagctgggacttgctgatattgttggactttgtcatctgtacttgaaatatgagaaagggaactgcttaaaatatctgggctccctttccggtagctttagttgtttcccatctttaaaccaaatgctgaaggcataacataaattaatgtattgctaaaggccgagtggataaaatacacaacagc

SEQ ID NO: 8088 - DNA, 598 bp, Homo sapiens
aatgtgtcttatttttaaaaaaatgtaaaaatacataaatagtagtagtataatgagaaactatatagacacgcaaacttgaaaaatcttctattaatttacgtgattactgtagcataatcccaaattaaactcactttttctggatgactgacttgggtaaaataattcatatatgaacaatgtgggtaaaaagaaaaaagtctccagtttacactataaatagagtgattttatcaaagcaaatattaggaatttatccttggctttttaaaacaaaaagatactaaaatacttgagaatcctaatttgataatactgaataatgccacagtttatcctggcagagtaggacattttaaaaagctataaaattcactatatactcggccgagcatggtggctcacacctgtaatcccagcactttgggagccgaggcaggtgggtcacttgaggtcaggagttcaagaccagcctggccaacatggtgaaaccccatgtctactaaaaaatacaaaagaattagctgggcatggtgatgggtgcctgtaatcccagctactttgggaggctgaggcaggagaattgcttgaaccc

SEQ ID NO: 8089 - DNA, 545 bp, Homo sapiens
ttatcaggtaggtttgatctgagatgtatagtaatgatgactttcttcttcgcccaagtattttgtgtaccttagaccagtttagcaaatgaagtccaagaactatttgaataagtcattcttagaaaataactttaggaagcaactgactccattcatgtgtatgcctctaattgtaggttcacttctgtccgaatatgaatttttaaaataattttagcattatattagcaatttgcaatataccatttttatgcatgtaaagttgtattctaacatatttactttttgctcatttgattaaatttattactgtgtatcccatcattaaggtaactaattttcagtaattaaactgttggtcttctgtttagccattattctcagttctgtgcaggagtgagctgaaacaaagttgtatagcccagagagtgagaagctgcatttcatgtctcccaacagtcagaaagggattatgtactggttaaggaaggagtttggcgaatattttgaaacccttttgggaaagcatagaatattgaaaa

SEQ ID NO: 8090 - DNA, 458 bp, Homo sapiens
tgctgtcgatgagaataaagttagaatgagaatgttcctagcatggtgcctggcatgagcagattctcagcagatgggccctcctgtaatccgctgagggctctcctgcagtgccagcagggatcctagtcattgtctccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatgatggctctcattagccctaactcctcgggcaccttcctacctggcaccattatgctgggactaccctctcactctgggagcttcacgataaacccatcttggcttaccctggacgcctgtcagctcctggcagggtgcaggccagagggataccttttgcaccatg

SEQ ID NO: 8091 - DNA, 541 bp, Homo sapiens
ttgttattctcctattactccaaactatggcaaccctaggggaggatcttttctttcattcccttccccaacccaacaaaatataagcaaacaccaggaatgctctgctccttaatcccatacacttttaaaacagtcctcacattagaaaatgatgtgagaaataaacacagatttttttttttctattgagatggagtctcactctgtcacctaggctggagcgcagtggcacaatctcggctcaccacaacctcaggttcaagcgattctcctgcctcagcttccctattagctgggattacaagcgcccgccaccatgtccggctaatttttgtattttccagtagagacgggtttctgccatgttggccaggctgatctcagaagtctgacctcaggtgatctacttgctttgcctcccaaagtgctgggattaccagcgtgagccactgcgcccagccatatttttgtctcatgttgagatgaatgcaaattaaagtatacttcaagaaacaataccaaaataatgcaaaacata

SEQ ID NO: 8092 - DNA, 300 bp, Homo sapiens
aattccgttgctgtcggcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggttttta

SEQ ID NO: 8093 - DNA, 337 bp, Homo sapiens
agctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacag

SEQ ID NO: 8094 - DNA, 416 bp, Homo sapiens
ggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaa

SEQ ID NO: 8095 - DNA, 339 bp, Homo sapiens
gaattccatctacccattattctttatatctcctacttggatcttaatctccactctggcaattccccataagctaaaataataaatgtgtccttaatcatttatttccaattccttaatatttctataatgattttttatgtgccagtcttcaccattctggtatctgcactcccagtttataaaaccatcataaacactaggcaattctgctctttttcaggcaaaaagttaaaaaaaaaagagcatttttatagtttgtgccacatctatagtaactgggactacatcaaacaaagaattcctggccaggcacagtggctcacacttgtaatccct

SEQ ID NO: 8096 - DNA, 424 bp, Homo sapiens
acagactaaattttctctgtaagaggttatttcctagatagttaatatttttggtactactttgtgctgtattttataactattaaggaatgttgcagagaaatgctatcaattgttaaaattttgccatgaatacagcagcctcactgaattctcttagtagttctaatagcttgccatttgattctaacaggttttctatgtaaaagatggtgtcatcttcaaacaatgatagtttcatttcttctctttcacctcttaccttccttgtgtttctttagcattgggcaggtccttcagggatatgtgaaacagtggcagtaacaaccagacatcctggcctctttgtttttttttccatgatgaagtctcactccgttgcccaggctggagtgcagtggcacgatctcggctcactgcagcc

SEQ ID NO: 8097 - DNA, 553 bp, Homo sapiens
aaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctg

SEQ ID NO: 8098 - DNA, 220 bp, Homo sapiens
caaagcacacaaatggcctaccatcttttattcttccttctagcttctggagagagaaatgattgttccagtttagaatgccaggagtttactgggtgtttgtattttttatctgtgccttaaaaaaattagattataatgaacaagacatctttatgttttacagggaaggaaaaagcagtgaaagtatgcattttcgaaagaaaagtgtgttgggaaa

SEQ ID NO: 8099 - DNA, 537 bp, Homo sapiens
cagggtagtgcatgtgacggtgtccaagacgcacagcagattttcattcacaaaaaaatctgaccacaagagctaaacggaaataccttccgctgtccttcccaagtcacagagcaaacacctcagttcccaggggtccgcatcagttctggtggaggcggtgactgtgagcgtgaccagctgggctaattcgtcctgacatttagttgggacagctatagtttcctacctctatgaccagagagtgaagcgtttcactgaagaactgtggccggcgtctccaggaaaggaaggagcctcgctttctccagggcaggggcagcgtggggcggggcaggccgggtgtgtctgtggggagtgggcgcgtgctcacactctttaagctgcgactgcttcctttaggacagaatgaagttcttcgaggaggccgatgaagacagaatatggataaggccaaacctacacaaaatccttctacatcttcatatcaaaacatgttaaacataaacctccaaatacctacagggatacaagcac

SEQ ID NO: 8100 - DNA, 408 bp, Homo sapiens
ggcacgaggaaagcttcatgttccgcacctggggggcggatgttatcaacatgaccacagttccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaagtacttaagctacattagtaagaccagaacttagtggtgagggttgaagctggctggacaggcagtta

SEQ ID NO: 8101 - DNA, 166 bp, Homo sapiens
aaccttttcaggctccaccatacccaggctcttaccttagcagaagcctgtgaagctggtagcagaaacgagaaggaacaaaattaactccaaggcagtaagccatccacaagaccactacacgaagttaaggctgtgtgaaagagggagtttatttaattttatt

SEQ ID NO: 8102 - DNA, 497 bp, Homo sapiens
cagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggatttttgaggaagtggaagctgaactgcagtttgtagaataagtaagagtttagtcaggcaaagcagatagacaaggtcattttgggtggagcgattaatataggcaaagtcatgcaatcatgaaatagcatgatatgtatgtgaaataagagtacttttgcattgtaggggcattaaacaggtgagcagtcactggagatg

SEQ ID NO: 8103 - DNA, 303 bp, Homo sapiens
ggcacgaggtcctccaagacctgattcagcctttcacacggtggtgccactggtcccagggtgcgccggccccatctcctcagggcagtgggtggggaagactcaccactacccctaaaatgggaagagaccagggttccaaagtgacccccagtgggggcttcacacgccagggagtacatgagatgatttctgtggtccctgatacacagctttcattttgagagacacaattatttgagtatctagtaattcaagcctgggattcaaagatatcatttaagatgaaactgaatatttctc

SEQ ID NO: 8104 - DNA, 183 bp, Homo sapiens
ggcacgagattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgt

SEQ ID NO: 8105 - DNA, 556 bp, Homo sapiens
cccattcccggaaggaggagacagttactgtctatcccgcagacgtggtgctctttgaagggatcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatgg

SEQ ID NO: 8106 - DNA, 377 bp, Homo sapiens
caagaggagaatgggatcaacagaaggcatatatggggagtgtctggatggctggaaaattccattttttgaccaagatgtggtaaacacggggagtaaagttataattctttctcttactgtgcttttaggttttgttgctttctgtctgtatgctgtgttccacaataataaaaatatttaaaaggcaaaaaaaagtaaaataatgaatataaaattacactgaaactacatattctcatagatagaattgtaattattagagtttttgctgaataaagtcaaatagactattatggtcgttataaacgcaagttaaaattttagggccgggcaaagtggctcacgcctgtaatcccagcactttgggtggctga

SEQ ID NO: 8107 - DNA, 509 bp, Homo sapiens
ggcttgctgataatctcattttataattggttcagcaatccagcaggaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtacaattcaatgaatttttataagtaaacacactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaa

SEQ ID NO: 8108 - DNA, 463 bp, Homo sapiens
tgcccctttttagcctcccagagcttcgaggactcaattcgaacccgaaatcctgccgtgggggaggggttgcgtcgagacctgggcccggggaggttctcctgcgtcactttctgtcctgaaaggcgcccttcctggtttctgtggctccaattttctatgcagccccacaccccttgttgttttgatcctgagaaataaaagggaggctgaattattcaaatttaaatgaggtttccccttcatggaagtgctgctgacccttcgtgcagaaatggggagcacttgaggacacaggtgggtggaggccctttgtgcgtggctggtcgtattcgggcagccctccgtcgctttttataaaactttgtgtgagaagaatatattgataatgtcagtgaaacaagcagacattgaaatggaggcacagattactccacaaggagttcttctgtatattttttct

SEQ ID NO: 8109 - DNA, 551 bp, Homo sapiens
ggcacgagcattagtatttttgtgatttcattttttacacttaaatattgattcatgtggaattcactttgatgcagggtgcagtagggctccagtttaatttttttttagattgctactcagttgtttcagtactgcttagtgaataagccatctttattatcttgagatgtcacttttattatgtactgaatttctctgtttatgttgggtctttagctgtactatgtggtctcttccattgatttgtcttttactgggctgtgtcatactgtttttaattattgtagtgttatattttagtatttggtgaggctagaccctcttcaattaacttttgctttattttttccaaaggaaatttaggagccggacacatatgtgtgttcatgtattttcattgggaatgcattaaatatatagattaatttagggatcattggcacttttgtgatgttgagtatgtctgttcaggaacatggtattgcttttccatttattcaagtctttcaagtattttttgggagcattttaaagttgtcttcatatag

SEQ ID NO: 8110 - DNA, 528 bp, Homo sapiens
ggcacgagagggacaaggctataaatatcattaataccaggttcaggagtttgcactgcactaaaaatcaactcagctatttgagcaccttttatagagtggaaatggggttgggcagtagagaagagcacttttagagaggcttttctgcagtagtcaggggttacacctgttaaccagccataattttttttttaagcggctgtgctgaggatgagccccatgtagttggtgcaggtggggacacactgcctgtgtaactagaaaaactaggcatggccgggcacggtggctcacacctgtaatcccagcactttgggaggtcaaggggggaggaacacttgaggccagagacaatataatatataatataatatattgaccagcctggacaatataataagagcctctctgtacaatttaaaaactaaaagcctggggtggtggcacatacctgtagtcctggctacttgggaggctgtggcaggtggattgcttgaacctaggagttcaatgctgtagtgagct

SEQ ID NO: 8111 - DNA, 559 bp, Homo sapiens
tcggcacgagacctcttcttcattgttaaaatggaaataataatactacctagctcgtgggattgttgtgagacaacaacaaatgagacaacagagatctgaaactctgcctggcccctggtatataccaagtccacagttaaattagcctttgttactaaatcattgtttgggtagaaatcctcagattttggatttctcaagtgctccttttctactgtccaaaaggcagaatgttatttttgctcgattccattatgtaatatcctatgaatttgaaatttcggaggaggcacagcatggggctgtggaaatggtgcaggtatctgcatccgaaactccgaagttgtgtggggaggtcctctctcctgagcccagaggcaaaaagctgctcccaagaaatgatctttatgccccacagtccaaagccccacattaaacaaagtctcaagacaagaaggcaatgtgaccctggcccccatgttttgatttgacttttaatttcaaaataatatcattgtgggggggcttatagtttttaacagctgaaagttatata

SEQ ID NO: 8112 - DNA, 544 bp, Homo sapiens
ggcacgaggtgattcctatttcaatatgtgaaacacttaaccaaagaatatatttcgatgaatcttaaacttgccttaaaaacagaagaggttaaaaagaatttagaaaaaataaagttttagagtgtttgagaatgtgtatataaaatattttcaaagccataatatggatgctcttatggctcagaagcatgcctactagaacacgtctcggaatgagagatgtttaattctgtcacctcccagaaagttttgcagggtttctcacttgaatttgcttccctttgcaacctcttgtcctgaaggcccccttcccacctggaaatgctgaggcatgggtgtgataagaatcagtcattttgaagagaataagatgatgactttattaacatttccatatatgctgattgtgtgtgtggcggggtgggggctggggtggaggcttaaggcaaaagctagaattagtcatatgaattatgggcttgtttggagacccacctgaggctcagccctagccctcagcccacctggggagtttactacc

SEQ ID NO: 8113 - DNA, 377 bp, Homo sapiens
  misc_feature 377: n = A,T,C or G
ggcacgaggggagacaggaaggagaagaaaaacaaaagtgagaaaaagagctgaaaatgggacaacaagaaagattcctttttaaggaaaatgaataaactacctgtcaaaataagtataacatccttttcattctggaattttaggaatggttgccttcccttccaaaaattccccatccagttatcataaagcgaattatctgacacctatacacattacatactaaagtatttattgaatgagcaaggaccaccagtcaacaagctctacctatatacaacatttccaatcagtctatctattctctcacattaaaatacgtctagacaggccaggtggtgttggctcatgcctgtctgtaatcccagcacttn

SEQ ID NO: 8114 - DNA, 119 bp, Homo sapiens
caagtctgtccagaactcccctggtgccgcctggcatgctgctgatagtttgcaatgtcttcacaagaaatggtatcagaaacctcctgtcatatcagcatgggtctcttgcttcctgc

SEQ ID NO: 8115 - DNA, 74 bp, Homo sapiens
aaagagtttatgacacactattccagcagcttcttgtttgtttggcttctaactaacttacattgggggagttt

SEQ ID NO: 8116 - DNA, 190 bp, Homo sapiens
gatcagttgtttgtatttcatcctaagcacaatgggaagctattcaagagttttatgcagaggattgactttgccagcactgcattaaaaaaattaacttaaaaattttaatgtagttcaaatctgcatgtctggttcatttcagctccttcactgccaaacctgggggcagggactgcttcagtttctc

SEQ ID NO: 8117 - DNA, 387 bp, Homo sapiens
gcggaaacagggatcagaaaggaaatcaaataacaggaattccatcctggacactggggcctgacaaagagctcttggaccagtgctggatgcaatttgggcggtttggtttgaatgggggaaatatgagtttccagaacagggtatttgaaatcatggctactcagaaaattgaggcagtggtcactctggctgtaaatgcggcactctgtgattgtcaagacctttgtaattgagggtgccttggctgggtccaggatatacttcatcataagccatatctggagccagcatgaattacaggggacaggaattcccattcatcggtcacttcccacatggggctagggatttcgtgtgtacactcattccatcttctcacgtggc

SEQ ID NO: 8118 - DNA, 107 bp, Homo sapiens
gttgtgcagtcaggaatagcatagagttaaaatgcaggaggtctgcctttgtattctcttggtatctactgtacaagttcattgtgtgctctggagttggatttctc

SEQ ID NO: 8119 - DNA, 102 bp, Homo sapiens
gtgggcgagggaatagtcagagggatcacaatctttcagctaacttattctactccgatgatcggctgaatgtaacagaagaactaacgtccaacgacaaga

SEQ ID NO: 8120 - DNA, 250 bp, Homo sapiens
gaatggggaaatgcattgtctaagtacctctacacctctacggtcccttctattctcagaataaacttaagttatgcttgagtataacttgagtaggggccacgtacgggcatcattgcgggattcagccacaatggtgtgattcaatctgccctctgggctttggttacatttaacgtgcattcattgaacaactaacttgactcaacactgtactaagtgctatataccagggatgtacaaaacagat

SEQ ID NO: 8121 - DNA, 364 bp, Homo sapiens
  misc_feature 226, 294: n = A,T,C or G
gcctaggctggtctcaaactcctggcctcaattaatcctcctcccttggcctcccaaagtgctgggattacagggatgagccactgtacctggcagccttgagcgatttctcacctcctcattggcccagtttccttatctgtaaatgagagtagctgtaaaatatggttaatgtgaggaccaaacgggtcaattagggaaaagcagtgtctctgccagctaattntattattattattattttttttttttattttgagaaggagcttacttgtctccaggctggagtgcagngcgaagactcgctcactgaagctccgctccaggtcacgcattctctgctcagctccgagagctggatacg

SEQ ID NO: 8122 - DNA, 479 bp, Homo sapiens
atagcgtttattcccctctttcttacttgaatggaatccatttttaagctttttgattttttttgtcataaaaaaaagcacataacattcttcataatagtattgttattcaactttttgtcatggttgaaatattaatgcaatactgaagtgtctataaaccagatttatttattaccacactgacaaaaagtacaactaacagttggcaggtagataacatcagaaaaatccatgctatgaaaaggaattttagtatgaactcatcaaagtaactagtaatttttaacagactctagtgacatatatgcctctctctctaactcaattataaaccctttgagggcaagtgttatgagtgagttgtgttcctccaaaattcatatgttgaagtcctaacctctagtacctcagaatatgaccttatttggaaatagggtcattgcaggccaggtgtcatggctcacacctgcaacccc

SEQ ID NO: 8123 - DNA, 413 bp, Homo sapiens
  misc_feature 353: n = A,T,C or G
ggcacgagaaataatcagctaatccaagaactgggtcctaaagcatacacatgcacaaacacatacgtgcacacatacatatgaacacgtatatttctattcacaaaccaaacttgcttcaaccgccacctccatattcatgccatcgggaagagctgctatcagcagcttcacctgtatgaatttcacaaggcttcactttcaccccagagaacatgtttctatactcatcctagcagaagaaatcagaacgtacagagaacccagatgtcactcttcagacttcaacgctcctgtctccatcacagtaaagtcccctggcattcttctctatagcctgtttggggtggggntaacagttccccaattctctcctcctgcattaccccacaccaccaaacaacccccacact

SEQ ID NO: 8124 - DNA, 339 bp, Homo sapiens
gactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctc

SEQ ID NO: 8125 - DNA, 399 bp, Homo sapiens
ggcacgagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatgg

SEQ ID NO: 8126 - DNA, 400 bp, Homo sapiens
ggcacgaggagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatg

SEQ ID NO: 8127 - DNA, 330 bp, Homo sapiens
ctgtgcatcttggacaactgattgaatcttgtgcctcatttttctgtggaattgaaacaataccctgacccattgggcaatggagatcaaatggcattgatgcaggtaacatgcttaacacagggcctggtatgtagtgggcattcagtaagtggaagttacgattattattaggtatcaaagaacaaaacttaattgtcagaataagcaaaccagttggaataataaacgtagcctttagagttaaatggcacaaccctgatagccacacataaactgttttggttatttttcgttggatattcccagtctttatttctacatccctct

SEQ ID NO: 8128 - DNA, 399 bp, Homo sapiens
ggcacgaggcaatgcccattcatcgattctcagtcctggccctgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatg

SEQ ID NO: 8129 - DNA, 214 bp, Homo sapiens
acgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggttgcgagaagacgacagaagggttctgctgcgagaagacgacagaagggtactgctgcgagg

SEQ ID NO: 8130 - DNA, 327 bp, Homo sapiens
ggaaatggggctgggggccgtccccgggagacaggcggccttccgagagggactggagcaggccgtgcggagtgggcattgcttgatgggcaggaagttgagtgttccttgcaagggtgctgtggcaagaggaggcctggtgtatttggcagcgttcctgaggctgtacatgatccacctgatggctggtcgagtaccccagggagctgatcgaatagcagtcaaggctgagatggaggccgtttttctggagaacctgaggcatgcagctggggttttggctcacgaggacctcgtgggactgctggagcccatcatcacgcgcat

SEQ ID NO: 8131 - DNA, 491 bp, Homo sapiens
ggcacgaggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctct

SEQ ID NO: 8132 - DNA, 347 bp, Homo sapiens
  misc_feature 312, 347: n = A,T,C or G
gccagttaggaaacagttaaagttgacccaggattaaatcaaatttggaaatagggggaaatgttctccacatggacagcaagtcacccatttgtgcatgcttttgccccagctagacacatctcccacatctctactgctaccacctggtctaagctaccatcatcttttccctgggccactgtaatatgctcccaagctataaaatataaaagctctgcaggccattatctgcttactcccctcattcactacactccagccatattgacctttctttttgtttggttggtttggtttgtttgagacggngcctcactctgtcatccaggctggagtacagtggn

SEQ ID NO: 8133 - DNA, 622 bp, Homo sapiens
gggcgcacgggtgcagtggcaccaggcagtggtggcagcaccgggtgggcagccatgattaatagagtgctgagggcacccctttccacaggtgcatggctcctgcccctgcttccatagatcatggacttagcctcaacatatctgactgaaattgaatttggcttctctctcagctgttcagttcctatattatacaaggttagatccctttctctatgagcagaagaaccaaaccatctgcagcttcggaggagaaaatgtgctttcaattatgcacctggcctgaatgttgagccgcagttcgatgggtccctaattgagccatcatggtgcgaacatacagggagacactgtgtgcatcaggcctgtgggttttgccctaagataatgacagtacagcagccacatcaccacggtgaccaccacagctgccaccactgtcacctccaccaccgcagaaggcccaagagcctgcagacatacatgctgggtgagaaggaagttacccagcaagggtccagggcagcaggctgtgttagggtccctggaaagcctccctgtatcctccagccagaatgcatcatcctgtccccagagtgcctggcctgctccacagtca

SEQ ID NO: 8134 - DNA, 647 bp, Homo sapiens
atcctttttaccttcttcctcccagtcaacctctctctttttcacgtactctaccaacatccccacccaatctccccttatgcctccaaaattagtcctatcctgattgtggagtttggggttttctttgattcaatggatgataccagtcacaccatttgaaaaaagcatatgacagtgttgttcagtgttggtgaacaggaattcttgatatttatttttaaggattccatttaattgctaattacagatctttgttaaattaagccgaccttcactcacatttaaaaaatttaactttgttttggttttcatgagacaaatatctctctttaagtgaacaagcttttaaaagaattagcttcttcagtatggaaagcaagatgcaattcgcagctggtgcaatggcttacaccagtatgtaatcccagcactatgggaggccgagggggaagaatcccttgaacccaggagttcaagcccgggctgagcgacacagtgagacatctttacaacaacaacaacaaaaacaaaataacaataacaacaaataattacctcagcctctcgagtatactgtaggtacaaagccaccacgtgtacctgtagtcccagctactcgagaggctgaatagagggattgcttg

SEQ ID NO: 8135 - DNA, 635 bp, Homo sapiens
  misc_feature 341, 485: n = A,T,C or G
attcgccaatggatgcaggaaaactgagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctgggattacaagcatgggccaccacgcctggctaattntgtatttttagtagagacggagtttctccatgttggtcaggctggtctcgaactaccgacctcaggtgatccacccacctcggcctcccacagtgctgggattacaagcatgagccaccgcgcccggcctccctgttccagttntctataatctgttcatattatattctgggtatatgtgggtggtgtgattatccatgtggtcttattttcacattctttgcattaactataatgacttaatgttttaagataagtttcattctacaaagatgtatgtacaatacctggtat

SEQ ID NO: 8136 - DNA, 292 bp, Homo sapiens
tcagcttacaaataagaatgggttcagggaagccaacataattacccacgttggaaaaagatctcttctaaccccgacaggttgtcaggattacaacaataaagaagatttttttaaaaatgttattaactggggaaagaaaaaaatgtaactttttaattttatcagtgaggtcacagggggtcaatcagaatctaacacatatgattaaaaagaccaaaaatgtaactgtgcaagattggattattcatttctgctatcacctcagtttttgaattctaaagcaacctag

SEQ ID NO: 8137 - DNA, 622 bp, Homo sapiens
gagtccccaagtggccatgttacatgtgatctgtgacatatacgatcagatgttacctgcatcctagggtcgcctggcatgcccatgagtgacgcttaggaccgtgcctggtgctggtgtgtggacaatgctgggccagtttgcccagggctatgcctgccacctctacttttatttcaccctctggaggcggacgcattggaaagcatgtggggcaggaggtgaggaaggaaattcagacaagctgagcagagcggccaggactggaatcttgggtgccaacccgcaaggtggggaaactgatttccatttcccagtaattacaggtcaataccacacctgagaaggcaggcaggaatggaacccagactgactccagggctttgttgcttcctgtatcagaaccaaaccccgggtgacctcctgttgcatgccccttgtcccaactttatagattaggacactgcagctccatcttgctacccaagagttaagactttttctggaggacctggctccccgggtttggaaatagtaccattgtttcctaactgggtgaccccgagcaagttgcttaccctctcttggcttcaacgatctcatctataaaatgggatcactt

SEQ ID NO: 8138 - DNA, 451 bp, Homo sapiens
gtgagcagagatcccgctactgcactccagcctgggtggcagagattccatctcaaaataataaaataataataataataataataataataataataataataatgtatcgaaatacatctatgttacctaccaagtctaaagaagccccagcccaagtattgcacctcttccctagtagggagtgtgatctacagcagctttcccttcactttgtacgaaatatctcaacatatcccagactcctagatggcttactgcgacgcccctatatatttgtgagatttattatccatcctctggcacacacatcatgccttaccaaatcatccaggatatctgctattcccttttcttaaggtccatcaagatgatgtcatcagtgcctcagcagattagcctgatatccattagaatggagatttagtaaaaaaaatccctgtaaactggc

SEQ ID NO: 8139 - DNA, 585 bp, Homo sapiens
aatgggaggctttccctgttgaaactcctcaaggacatcggttgccaaggtttattaagagtgaatcttccccacatgggttatcccctctactgcctctagtgacagaggatcacatttcactggcaaaattattcaggaaataggaaaggttacacacaccagccaaatattccactggacttaccatcctcagtgataaagttctatacaaagagccaacagcatcctcaagctgaactggctaaactgtctgaagaaagaacttgccatggccacagatattacccatcacactgactctcagatccttggcccttccttcacacaaacgatcctctttgaatcattacgggatacccatgagaataccctactaatgcaaactagcagaagattccaaactaactcagttcaacaacctcagatattgtcagggattaattaaatacacacagcctcactatactccacaattgaggcttcttgtatctttaaactccctgatcagtccttacttgcttcataagtaagtgatctggcattttgaaaaaacaccaacatcagaaaactaaccttgaaccc

SEQ ID NO: 8140 - DNA, 495 bp, Homo sapiens
attacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagagaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaact

SEQ ID NO: 8141 - DNA, 453 bp, Homo sapiens
caatctcaaagctattcctgagaatccaaaccaatatagtccccttgtttttcaattttttgaagtatgagaaaaaaaataagaaaaagttaacatacatttccaatactaattttctgctctcagagctttaaccgctcagtaatgcataaaacaaatatttataccaaggatatgaaccaaactgctacaggtaatctcttcaatcatgatcaacaagtcttgtttttttctaatcctagatagctttacagggtaacaactgtattaaattgtgacaaatttgctgttgtagaccaaaagtcactggcggctaatatgcattctaaacttgcaacaaattaaaagttttcaaaagtactctacctcctctggccaaagtgtgaaattatatagtttttaaaaaatgcaggctggcgtgatggctcacacctgtaatcccagcactttggg

SEQ ID NO: 8142 - DNA, 582 bp, Homo sapiens
catattttttaattactttatttaatacagagaagatgagaagacaatgtaaatgctgctttgtgagtgatgggaagaagtacttttagtgatagcagtgaatcaaagcataaggtcatcaatagtcgacttcattgcccagtgttttcaaagtccccacgtgtgttggttattctttagtaaagtagacgtgacaatgctcgttggctgttattgtgaagcttgactgataatactgggattttgagatcaagaggctagaagccaagatgtttgaaatatgtaaggtcagctgcctgctctttcctcctcccctacgagtgaatcaacacttgctttataagcttttcttctctatctcctttctctattgttagtttcacttcctactcttaaaaattctgagctttcaaaatcatgtttatcaggagaaaaaagagactgaaagagcttaaaatgggatacctctggccgggtgcggtagttcacgcctgtaatcccagctcttagggaggcagaggcgggaggatagcttgagcccaggagttcgagacctgcctgggcaatatagcaagaccccat

SEQ ID NO: 8143 - DNA, 482 bp, Homo sapiens
tcatatccggataaaagaaaatcttcaatgaattgcaaaatctttagaggcagaaggcacccaagagacaggtcaccatgcagaacaattctaggtggctccattcacatttagcctatgtacgtggtggcccctgggattgtgcagtgcgcaacttacacaactgtatgcagggattctgctgaatccagtcattaccacccttgcccttcctcacacacagatttaggatccttttacagaggaggcaagtgaggcccagaggaggaaagcaagttgttcaaagccacccagctaaccacagagccagactaaaatccagattattgaattttagagcaatattctttcctctctacaatgatgactggaaaggatattgtcacccaaaacagccacctccaccacagcaataagttcattcttaaaagtatttgtttcaggccaggcatggtggctcacgcctgtaatcccagtacctt

SEQ ID NO: 8144 - DNA, 495 bp, Homo sapiens
aactagatggagtcctggcactcactgtgattgagaacacatgacaaactaataggtttactgggcaggcggctaagctgatctacttgctggttcaattagctccactttccggaggctagcattttcccaaccttgccccatgctcttgtgggtacatttaccctatttggggccttagcgctttacaaatgaacgtttcagtttaagagacattgccacataacttatattaagtggtatgaattcaaaagcaagctctgccactacacatcagaatccagcactgaaggaggtgtggaagtcagaaagatggacaggaagatcccttcaggcttaaaaaggaccccagggccgggcgctgtggctaacccttgtaatcctagcactctgggaggccgaggcgggcggatcacttgaggtcggcagatcgagaccagcctgaccaacatggagaaacgctgtctctactaaaaatacaaaattagccgggtg

SEQ ID NO: 8145 - DNA, 465 bp, Homo sapiens
agaaagcagccaccattggcaagccaagagagagccctcaccaggaacgattggaccagcaccttgatcttggattttctagcctccagaacttacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtg

SEQ ID NO: 8146 - DNA, 328 bp, Homo sapiens
  misc_feature 328: n = A,T,C or G
gccacccagtttcacacaggccagagaggctgacctacctgcccagaggcaggggaagaatccagaggacctctcccggaggaggcacgagaagcccacgtggcagccaagaagagggagagcatcctgggccccggaagcacaatgccaggggcagacatgcactgggaggcacggggccagggacaccttcagtgagcacagggtctgggtaggcttcgggaggggtgagggcggagaggcagccaagccgggttgtgggaggccctgcctaattctgtaaagactaggattagaaacatgacaaaaatgggttaggcacggtggn

SEQ ID NO: 8147 - DNA, 155 bp, Homo sapiens
cgagtgggaagctggtcagaggggtgggcactcctctgggctccgccacctcctggcacaccccatttggtctctgtccactcctgtcacctgctgtttttgaagcaaattttggaattgtgtcattttatttgtcagtatttcagtatgtaaag

SEQ ID NO: 8148 - DNA, 350 bp, Homo sapiens
aaacaccacttttgagatgctaaaaattcagtcccaatgggacttgttcaaattcagttcagtttctggtcatcaaaaaatcaatctgttttaagatctagtcttacccatgaaaactttaataatggtagatatctaaaacatgagttaattacccccaaaatgtttcagttttttcattgttatattgccaaaaaccattctggctatatatatttttaaaagaagccatttgcatgtcctttagtggtagaatagaaatttggttaaaattggatgacatttactttaattatcttcaaagtatgatgaacttttcatgtgtggaatgtgtggtctgataatttttt

SEQ ID NO: 8149 - DNA, 549 bp, Homo sapiens; identical to SEQ ID NO: 503

SEQ ID NO: 8150 - DNA, 398 bp, Homo sapiens
catatagagattgcaactgagagttggtcgtaaaactaaaaatattgttgggaacagagcaggtcaaaactcccatgattgatctaataatggaattatactggtaaaaagccactgcacttcagcctgggcaacatggcaagactctgtctctaaaaagagacaaaacagcataaaaatatgcttgatataaactctagccctcttctagttatttgttcatttgtacattttcatttcacgcctgtaatcctagtagtttgggaggctgaggctggcagatcacttgaggtcaggagttcgagaggagcttagtcaacatggtgaaaacccgtctctactaaaaatataaaagttagccgggcctggtggtgggcacctttaatcccagctagtcg

SEQ ID NO: 8151 - DNA, 300 bp, Homo sapiens
aattccgttgctgtcgaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaa

SEQ ID NO: 8152 - DNA, 282 bp, Homo sapiens
aaccgatcactaataaacatcagaagaacccaaattggggtatgttctgcaaaataactggcccatagtcttcaaaaatgttacggtaaaggaaggtgaagaaaggctgagaagttggttcagattaaaggaagctaatgagagtggccaatgcagcttgtggtcaccagtttggttctggaccacgcagctcatggcaagaaagatattatttggataactggtggaatttaatatgaactgtggggctgggagtggtggctcacatctgcaatcccagcg

SEQ ID NO: 8153 - DNA, 340 bp, Homo sapiens
gcccccaaactcctccatcccagcaggcccagagccactgataatctcagcatttcctggccctctctgtctctttgcttctctctacctctgtttttctttccatttatattcctcacctgcccttcctcttaacatgtagctgattccctaaggcatcgtgttgcagtaaaaagacctggatgctggattcttacagaccctggtttaaatcctgacttttacacttatcatatcactgatacctgttaaaatctgtatttatcacctctcaaaccctcagtttcttcatctgaaagtgggtatactagcttgcctcattggatgacatattgaacaa

SEQ ID NO: 8154 - DNA, 457 bp, Homo sapiens
attccgttgctgtcgaaaagaagttaaaacgttcccacaggcccataaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcggg

SEQ ID NO: 8155 - DNA, 212 bp, Homo sapiens
acgacagaagggtacggctgcgagaagacgacagaagggtacggctgcgagaagacgacagaagggtacggctgcgagaagacgacagaagggtacggctgcgagaagacgacagaagggtagccatgtgtggtggcaggcatctgtagtcccagctatttgggaggctgaggcaggagaatcgcttgaacctgggagacgaaggttgcagg

SEQ ID NO: 8156 - DNA, 296 bp, Homo sapiens
tcatgggaagaagttgaagggttttagttagggagagtcataataaaggttgcagtttaacaatgtcattcttgaggaataccaggtaaacttacagatcaaacacttaatttatttctacttcctccgaaaactccactgacatgaccataaagagtcaaataaaggccaggcgcagtggctcacgcctgtaatcccagctatttgggaggccgaggtgggcggatcacaaggtcaggagattgagaccatcctggctaacacagtgaaaccccatctctactaaaaatacaaaa

SEQ ID NO: 8157 - DNA, 509 bp, Homo sapiens
cattcatcactatttttagtttaaaacaagagcaacacatctggaaggtattggcttttcaagtcaactgctggaaagacagctggggggtgtccatttcaggaggcttaccttggtatcctggggtcgtgccacgtgctaactccagtctgtgtatgcaaaaagtaaacttggccctggactgttgttctttgttctacacaagaaattagagatccaaatgagacaagttcaattccagggagagtttgtaaccaaccctcgatgccctcacgtctggtattatctaaatctagataacactcccctcttatcccagttcttctctctgaggtggccgaataatcccctcttctccatctcgccccatgctctcctttccagaacactacagacaccctcatctagcctacatgttaccttggtttgctttggtgttcgtttgcctaagattttcacttgatttctaaactgggagatttggagcaattgctgaaaattcatgatta

SEQ ID NO: 8158 - DNA, 430 bp, Homo sapiens
  misc_feature 375: n = A,T,C or G
gacagaagggctgatccactccaagtgttctcagggcattgggtttttatcctatgacgatgttaatttgacaggcaatttgtctccacagcactcttctcttcctctcctatagtggggacagcatctagtgcttcaattaccttttcagtccagtcatttgcacagggcttcgatcactctgggccaagcactgtgctaagggttttacatgaattatctagttcagtccttacaaccactctatgagatgggttttatcttcatcattctcatcttacaaatgaggctcacagtagttaagtaagttatgcaaagatacccagccatcaagtatcagagcaagaattcaaacccaactttaactcacttcanaactcaagcttggctgggtgtgatggctcacacctgttaccccagcactttggga

SEQ ID NO: 8159 - DNA, 143 bp, Homo sapiens
gaggtttctgacccccatacccgtcctgcagccttcgagcaaatgtgtggaaaggaaaataacccatatcgaaatcagaacaacggtgttttaaaaatacgaattgagtctggccaggcgtggtggctcacgcctgtaatccc

SEQ ID NO: 8160 - DNA, 597 bp, Homo sapiens
ataactcatgtgataaaggccactattagttattccattgaacagcaggagctggagcatgaaaagggtaacgatcagttcaagttcattcagaaatccttgactctactgtctcagcctcactctgaaatacatttttataggccaaggatcagcaaacttcaaccagcaatccaaatctacctccatgcctatctttataaataaagttttattagaacacagctatacccagttgtttacatattatctgtggctgctttccacactgtgtcagagtcgagtggctacaatagagactgtatgacccacaaaacctaaattatttgctctctggacctttacataaaataatttgtgacctctaatctagaccaccaatagttttgtttcttcctgcccttcttaaaattctgatcacaggccgggcgcggtggctcaagcctgtaatcccagcactttgggaggacgaggcgggcggatcacaaggtcaggagatggagaccatcctggctaacatggtgaaaccccgtctctactaaaaatacaaaaaattagccgggcttggtggcgggcgcctgtagtcccagctactcg

SEQ ID NO: 8161 - DNA, 500 bp, Homo sapiens
ctggatgtcagcaagaatggaatacaggagtttccagaaaatataaaaaattgtaaagttttgacaattgtggaggccagtgtaaaccctatttccaagtaagttctcaggctccctgatggattttctcagctgttaaacctaacccagttgtatctgaatgatgcttttcttgagttcttgccagcaaattttggcagattaactaaactccaaatattagagcttagagaaaaccagttaaaaatgttgcctaagtaagtaaaggtgctattctttaaaaaacttaatttataatttttaatgattaagtctttaaaaatgtaaatttttattacctaaaatgtggtgcaaattatttgtaaatcctgactgtgtggtcatcatatttaattaatggtgttaaaatattaaaatgtatgtgtctgttgttggtgcttaacgtggtactgtgttggtaatgatttatagctgtctgaaatgcagtcttgtgtgtgaca

SEQ ID NO: 8162 - DNA, 587 bp, Homo sapiens
ggacagcgacctggattgtccttctcccttctctgaaaaattaccccccatatctcccgtgtccacgtcaggggatgtctgcaggttggtttgccaggaagtgccattctagccatctctgctcgcatcaggaacctcctcttgctttagtatgtgaagtttcaggaaaatgaagtaataggaagttgtaaccagttgtgggttgatggttttctccagaagaatggagtatcaatatcgtttgaaaaacttaatttttatgatgtgagtcccaagatagttttacaaatgataaaagaggaagaagctggctgggcgcagtggctcacgcctgtaatcccagcactttgggaggctgaggcgggtggatcacctgaggtcaggagtttgagaccagcttggccaacgtggcgaaaccccgtctctactaaaaatacaaaaattagccgggcgtggtggcgggcgcctgtaatcccagctactcaggaggctgaggcaggagaattgcttgaacccgggaggcggaggttgcagtgagccaagattgcgccattgcactccagcctgggcaacaagagtgaaactct

SEQ ID NO: 8163 - DNA, 591 bp, Homo sapiens
cgagggccgctcctccacagtccccctgtggctgtggcaacagccaagactgctgctgctgctgctgctgtgaaggagcccttctttggccaaagctagggaaggaatttcaggggaacttagaaaagtagatcatacatgccagcgctgaagcagaacttaagatcagcaagtcaccacctgcctgattttgaatcctacctatgctatctttcacaagcagacatgcaagctgtgcttgaatagcctgcattagaccggatactctgaaaaacagatgtcaaggcaaaattaaatgtgcagagattttggctgggcacaatggctcacttctgtaatcccagcactttggaaggccgaggcgggcggatcacctgaggtcaggagtttgagaccagcctggccaacatggtgaaaccccgtctctactaaaaatacaaaaattagccaggcatggtggcaggtgcctgtattcccagctactcaggaggctgaggcaggagaattacttgaacccgggaggcagaagttgcagtgagccaagatcgtgccactgcactccagcttgggtgacagaacgagactccatgc

SEQ ID NO: 8164 - DNA, 600 bp, Homo sapiens
ttctagagcacgcaacctagatccctcacatgtgcagttcacaatagggttcacactcctatgacaacctaatgctgccgctgatctcacaggaggcggaactcaggtgggtaatgctcgctggcccaccgttcgcatcctgttgcacagtccagttcctaacaggccacggaccagctgaggacccctgctctagagaatcgccaaatgtgagggtggtcatgaaagtttcaaacaggtgttaaaggcaaagtgatataaaagaatcatcactgcagttttaaagagtcctataaggaagaactctcatctttttctcttgatcaaattcactttcagaccaaagagacatgcatatagaatttaagcagaatactgtgattcatgtaagaaaaaataaactacagagatccagaaaacaggctgggcgcaatggctcatgcctgtaatcccagcacttcgggaggccaaggtgggcagattccttgagcccaggagttcaagaaaagcctgggcaacatggtgaaaccccatctctacaaaaaatataaaaattggccaggggtgggggtgcacacctgcagtcccagctatttggga

SEQ ID NO: 8165 - DNA, 95 bp, Homo sapiens
cgagactccatcccaaaaaaaaaaaaaaaaaaaaaaaaaaaaagggggcgttttttcccgaaacccccccctgaaaaaaaccctggggggggggg

SEQ ID NO: 8166 - DNA, 204 bp, Homo sapiens
gaagatggggaacgacttttaatgggtttggagttctagggagagggttaatgaaaatgttcttagacttagataaatgttctagacttacgaaaaatgatgaccaatttctccactaaaaggataaatgaattattggttaaggaaaaaagaatgcattaacagtctgggtgcggtggctcatgccagtaatcccagcacttc

SEQ ID NO: 8167 - DNA, 604 bp, Homo sapiens
gaacgcggttcccggggagactgtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtaccctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcggtgtgaaactgcagcacaacagaaatttgctgaagaacttcaaaagcgagaacgttttttacttgaaagagaacaactgcttttcagacatgaaaatg

SEQ ID NO: 8168 - DNA, 567 bp, Homo sapiens
tgcccaggctggagtgcagtggcgtgatcttggctcactgcaaactccgcctcccaggttcaagcgattctcctgcctcagcctcccaagtagctgggattacaggcacccaccaccatgcctggctaatttttgtatttttggtaaagatggggtttcaccatgttggccaggctggtctcaaacttctgacctcaagtgatccacccacctcatcctcccaaagtgctgggattacaggcatgagccactgtgcccggccacatttgtttccttttaagaggatttttacattatgttaaaaatcttgattggtagaagttatatttcataattttcttcttcctttgtatgaataatatgcttttatagtgacgtcacaagaggtgccttttgcagagtgcctcatacgtgtcactggactaagtaagcattttatctcattaatcttcacaacaggctattagagtattataattttaattttgcagatgagaaaactgaaacttaaaatgttttaaacttggcaaggcacggtagctcgatagctcacgcctgtaacctaat

SEQ ID NO: 8169 - DNA, 548 bp, Homo sapiens
aactgttgtatttttaatagacaatttcacgacgttggcgaggctggtcttgaacccctgacctcaggtgatccacccgcctcagcctctcaaagcgctgggacaggcgtgagacaccgtgctgggacagtagtaacttctaatggataatgtatgcgtggggtggaaaggggagtaccagtatttttatttcaaacacatatacaaaacaccagcttgcaattcaccctgaagaaccctcagcacagagcagtttcataagtccatgccatcgtgccatatgccttcttcactggccacttcgattagtgaggaaagaatccaaagaagttaaaatatagtgggccgggcacggtggctcacacctgtaatcccagcactttgggaggccgaggcgggcagatcacgaggtcaggagattgagaccatcctgctcaaaatggtgaaaccccgtttctattaaaaatacaaaaaaattagttgagagtggtggcgctcacctgtagtcccagctactcaggaggctgaggcaagagaatcgcttgaac

SEQ ID NO: 8170 - DNA, 571 bp, Homo sapiens
tggagcacactcctgcagtcattcaaggaagaggcaaggcccatgattggcattctcagtcaaatcacacgaagggctgcttttctgatatagtaacacccaacagatgaaatcaggagatttcctcttcaagccctttacatttccattgtggccagagtctcagatctgggtgcagacacaaccctgctacactacaggcctgtcctttgaaattcctccacatccattcctcaagcagtctccagtctgggtcaagctcctggagaggctcatcttcccacctgaactctcaaacatccttggtcacataggattgattaagaattcattcctggagctcctgctgcagaatttcctcctccctattcacctctgtgcatctctttacttccttgtttaagaaacaagggcaggccgggcatggtggctcatgcttgtaatcccagcacttcgggaggctgaggcaggtgtatcacctgaggtcaggagttcgagaccagcctggccaacatagtgaagccctgtctctactaaaagtacaaaaaattagctgggcgtggtggcaccc

SEQ ID NO: 8171 - DNA, 54 bp, Homo sapiens
aatggagggctctgtgaagtctgaagttatttattattgaaaaggaagaaaagt

SEQ ID NO: 8172 - DNA, 353 bp, Homo sapiens
gtcatcaacatcctcattgtcatggcaaattgtgagtttatctttgccagtgtcagatagttcatcaacttccttttagccagattgcaaaaagtcccatgactctatttccaactccaatgccatctgacatgagacaaaatcagagtagattaagatagtggtcttaactgaatgtagttaaagtatgctacttgtgcaaatttttcagaaatatatgaccatatgaacatgttgctgaggccttgccaggccttgaaaggggcctgtgcaagtgaggggcacagagattaagttttattagcttctcagaaattctacctctgaataagatttttgagtactttgcatgc

SEQ ID NO: 8173 - DNA, 200 bp, Homo sapiens
cctacggttgcgataagacgacacaacggcccaaagtgctgggattacaggtgtgagccactgctcctggccctaatttttatttttttagtaaagatggggtctcgctacgttgcccacgttggacttgaattcctgggcttaagggattctcctgccttggcctcccaaagtgctgggattatggcgcatgatccact

SEQ ID NO: 8174 - DNA, 363 bp, Homo sapiens
  misc_feature 193: n = A,T,C or G
aagacgacagaagggtacggctgcgagaagacgacagaagggtagcctggcttaatccacgtattgacttgaacccggcacctctgcatgctgggcacacacacatccacacaggtgagcacagtcgtgtgcacctgcacgttacacaggtgaacttttctcatccagtcctgaggtttccactgcatcttanacacttagccgaggtgtgtcaggaccagcaatgttgtctttgcggccctttgatggtcccctttgcagtcagtcatcccagccatcaaataattgaacacctgagattcctttcagcaaatcatagccattggtagatgcacaaatatttaaaaaaaaaaaaaaaagggc

SEQ ID NO: 8175 - DNA, 343 bp, Homo sapiens
tcaaagtctggtgtagaaatacagcggtgaagagtttgactgtgctttccggctggcacacgagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaatcatcgtgctgaagtatgaaccagattctgcgaatccagacgctctgcagtgtcccatcgtcttatgcggatggcggggaaaggcctccattcgaacttttgtgcccaagaatgaacggcttcattatctc

SEQ ID NO: 8176 - DNA, 421 bp, Homo sapiens
  misc_feature 393, 414: n = A,T,C or G
ctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcccaaaagcttataatggactaaggtgnacatgtgcatgtgcatggaangataaaa

SEQ ID NO: 8177 - DNA, 160 bp, Homo sapiens
ttatactaggaattctttataaacttaataaatgaaagctttttctcttataggcccgattctctagtggacttctggtgaaattatgtggctaccttccattaatgttaatggaggttatggatataaatccctccatagtgatggaagaatgagcccc

SEQ ID NO: 8178 - DNA, 400 bp, Homo sapiens
ctggccctttcttaaaacatttctcttgcttataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgccc

SEQ ID NO: 8179 - DNA, 377 bp, Homo sapiens
ggcaccaggccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctc

SEQ ID NO: 8180 - DNA, 329 bp, Homo sapiens
ggcacgagggaaggattagaagatattgacgaagaaagggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttccccttttgggccaaacccccttttttttggggctttttttttttcccccagggttccaatttttttggggggaaaatcctttggccaaaaaccaggggaaaaaaattttttccccttttt

SEQ ID NO: 8181 - DNA, 621 bp, Homo sapiens
cggtgagtgtaaatttggcactgaagtgtggatgcagactcccacgcccctttaaagtttttctagagcttccatcccaagcagagccctgcctggccatcttctttgaaggactcagcacttctgctttcataaggcttggtgggtgtttctagaccttcctaggcattgaacctatgaccacacaggacacccctttctctgccctttcagtctcctatctgcccctctgggtcagtggttctcttgtcttcatccaagcctggtcaaatgtgcaagccaccctaggtctgaaggaagaaggaaggtgggtcccagtcttggaaggtactgaacccacgtggtttccttgtttgctcaaaaacagccaaaataagggccctcattccctcgctcaggttagttagaaataggacaaatgagtaaaaaaaaatatacaaggaaatgtttttggccgggcacagtggctcaagcctgtaatctcagcaccttgagaggcaggaggatcacttgagcccaggagtttgagaccagcctggacaacatggcaaaaccctgtctctgaagaaaaatagaaaatgtgcctgacatggtggctcatgcctgtggtcacagctactc

SEQ ID NO: 8182 - DNA, 624 bp, Homo sapiens
agcgtgtcgtgaaccaaggtcgtcattattctagcacaccgaaggtacacccatttcaaaccatgtgagctgtgagtaggcacagggttgggtcgctggggtgggaaaggctgcatgcgcttgtgcctaaggatgtttaacatgagagagctggaatccataataatggttcgcatccacccttgtatgatcatcaggatctcagccttcctcattttactctgtccatttcatttttgcttttattttttatgttaattgtaggcaaattaacaccttgtttaaaaaataaactggtgggcatggtgcctcacacctgtaatccctgcactttgggaagctaaggtgggagggttgcttgagtccaggagtttgagaccagcctggacaacatagtgagaccctgtctctacaaaaataaaaaatattagctgagcatggtggcatgcacctgtagttctagctactagggaggctggggcaggaggattgcttgagaccaggaggtcagggctgcggtgagccacaatcatgccactgcaccgtagcttgggtggcagagaaagactgtctcttaaaacaaaacaaggctgggcacggtggctcacacctgtaatcccagca

SEQ ID NO: 8183 - DNA, 637 bp, Homo sapiens
attatctactggatttttactttcatgaaaataaaggacaccttcaataaatgagtttttactgcgttttggtttttagaaatacggtcttactgtgttgccctggctaaattcaaactcctgggctcaaataatcctcctgcctcagcctcccaagtagctggggctccaggctcgtgccactgcacccagctagttttcacttctttaaggtgcataatgtaaacgtgaagatgatagagaaagcctgtgttagacatttgcatttcatgggattgagccaaatctgggctgtttgctttctctcatgccaggcagggcagccaggggaggaggtgtcagcatggcatctggcaaaggggagaagaggacactcagcagggaggagccattactcaggctggggtccgtcagcctctgggcttcaccagcaatccccaggcagagtttaatgcagccaatcaaaagtgcatagctgcattcagctgagcccttgatctgaagtggctctactctggtcaagggggctcaaactccttggctaggacttgaggcatcaaagatgacaccttttcctttgggaagtactaatgagcctactcaattctctagatgtttcctaacactagtggtaaac

SEQ ID NO: 8184 - DNA, 616 bp, Homo sapiens
tgctggtcccactacaataattacacccacggctagaacatggagcaaagcaacaaatttcaacatcacagggtggagagggcagggagaatcacaaagctgttgaaactgaagttctcaatgcgtgcgatttatggctgagcagctatctcagtctgtagcatcaaagccttaggtgagagcagaggtgacagggacacccaatgcctcggtggccagttcctgctcaatttgaggtcacaggtcacatgagatctatctgttgacttggaaactcttcaaatctgggcacaactccctgttcccacagataactccattcttctcacacgcttttgggtatctcgagtggtgattgagaatagctcctgctcctctccttctctgccagctgctagaggaaatgtctccactatgaatagtaggaattgtgtttaatatttgcgagatttgcttcaaaatcatgtggataggccgggcgcggtggctcatgcctgtaatcccagcactttgggaggccgaggcgggcggatcacaaggtcaggagatcgagaccatcctggctaacatggggaaaccctgtatctattaaatatacaaaaaattagacaggcgt

SEQ ID NO: 8185 - DNA, 648 bp, Homo sapiens
cactataatgtaaaaaaacaattaggcaaggatagatatatgtaaaataggtgaagggtggggatcaatccgaggaaggtgtgccaaacgggaagacagcttcacaatccagtctgttgatttacctaggacttgtagctagggtttaaactgtttttgccttgaaggtggtatttcactgggtgtgtgccctgatctgcctaggagttgtctgccttctaccactctcaataacaaaaattgaaattgcacaaatctttcaattacggatgatgacaaaaacactattaaacattaatggagctttgccatttttagaggttggagttaaaggctgaccatgataatccctttaaagtagccactacaattaactgctacctcttatcccacaaattataaagtatcttcctattagagacatctcaaagcactttgggaggccaaggttggaggatcacttgagttcaggaattcaagaccagcctgaccaacatggtgaaactccgtctctactaaaaatacaaaaattagccagacattgtggcatgcacctgtaatcccagctacttgggaggctgaggcaggagaatcacttgaacctgggagatgaaggttgcagtgagcctagatcacgccactgcactc

SEQ ID NO: 8186 - DNA, 438 bp, Homo sapiens
  misc_feature 368: n = A,T,C or G
tacggctgcgagaagacgacagaagggtacggctgcgagaagacgacagaagggatcccaacaagaaataccttgacacccctggccgggcgcggtggcccacacctgtaatcccagccactttgggaggccaagtcaggtggatcacctgaggtcaggagttcgagaccagcctggccagcatggtgaaacgctgtctttactaaaaatacaaaaattggccaggtgtggtggcaggtacctgtagtcacagctctcgggaggctaaggcaggggatttgcttgaacccgggaggtggaggttgcagtgagccgagatcgtgccattgcactccagcgtgggcgacaagagtgaaactccgtctcanaaaagaaatacctcgacaccccttaaatctaaatactcatagtcccaaaaaaaaaaaaaaaaaaaaaaaa

SEQ ID NO: 8187 - DNA, 564 bp, Homo sapiens
atgacctttccccgctttcaccagactcagtgaaggacttctctgaggtattgacagaggcctcagatggccaaggggccagatcctctttctcctgcactccacactggattgtgacacaagcaaaagatcatcctttatttatgttacttatgttaaatgactgagatctggaccttgtttgttagcttatcctgactaatgcatacaggaattttaccattatgagaaagacagtaaaaatattagacaaataccaacttaaaaattctaatatgatctaggctgggtgcagtggctcacgcctgtaatcccaggactttgggaggccaaggcgggtggatcacgaggtcaggagttcgagaccagcctggccaacatgctgaaagcccgtttctactaaaaatacaaaaaattagccgggcatggtagcacgcacctgtactcccagctaatcgggaggctaaggcaggagaatcacttgaacccaggaggcggaggttgcagtgagccaagatcgcaccactgcactccagcctgggtgacagagcaagactctgtctc

SEQ ID NO: 8188 - DNA, 549 bp, Homo sapiens
tcttctgacctcgtgatccacccacctcggcctcccaaagtgctgggattacaggcgtgagccactgtgcccagcctaggcttcatttttgacccctccatacccattcacacaaatgtggttccattattttgatggatcaatttgttccgccaggacaactgtaatatgtctggcagtgctttcactttgatcatctaattagatttgctcctctcacccaccctgagagataggtaaggacatggattctccctaaattaactggctggcaacaagataattagtcacaatgtttgaactggcttattaccgcctgctcaggcattcacaatggaggcaattttcttaagtacatgttcaaggcaaacaagggtcacctggtatggatgtagctgttgagcgttagctgagcctcatcttgaagggctgcaatggcggcagcattccggaaacttctcagttcagaaccactatgtgtaggaactagaaatgaagaccaggaaactgtgatagacagcatagaaattgcatctgggagccgagcgc

SEQ ID NO: 8189 - DNA, 323 bp, Homo sapiens
ctgtagctggcctcagtcattcagtccacaagcagagagaacccctactgggtggctgacactgtgccaggccccaccctcaagatgctagagaagagataggacaggcccaggttaatctcttttccaggcaggctgtggagtaaggaaggaccacagcagagtaaagcaatggagaccgacgtctcagaaaccctcagggaagttggcattttaactggtctttgaagaccaggtaaggcttttaaaaatgtatattaaacaaattaatttttcccattatatatgtagttaagacatgttcataattttttttttttgaa

SEQ ID NO: 8190 - DNA, 91 bp, Homo sapiens
ttatcatggtgcttggcatattgtaaatactcaataattatttttttctaaaaaggttgaatgaatttctactgcaggttttgggctttta

SEQ ID NO: 8191 - DNA, 384 bp, Homo sapiens
aagttcaatttctctataaattaatcattaatgttgaaggcacactgaagcaagaccagcatatgggcccctgagtcaaattaacaaggttttcttgaagtattaactgtctcctatataaatattgtaaaggttatgaaaggcttatggaagttgtatcttatgatcaagattaaaattttataatttttaaataaaattttgaaaaacaaatttacttggcttcttgtgcacctgtccaagattaagcccgtttcttatgagtccccacaggcacctgagaaggacaccatggcctacacttgtgaacccttataatacctaaagctgttgttttagaaataaacagataatggggccaggcgcagactcacacctgtaatc

SEQ ID NO: 8192 - DNA, 552 bp, Homo sapiens
aacacatatggtatatgatatatgtattatgggactgtattcttactaaaaagtaagctagagaataaaaaatttattgagaaaatcataaggaagagaaatatatttactattcattaagcagaagtgaatcagcataaaggtcttcattctcgtcatcctcaggttaagtaagccgaggaggaggaggaagagaaggggtttgtcttgctgtctcaggggtggcagatgatggaagaaaagccacatataagtagattcgagcagctcaaacctgagttattcaagggtcaattgtgatttgatttcctctagcctttaagtacatccaatttactaacctctttatggctgccttacctactatgccagaaagcctgcttttctcatctaaatccttttaaattatagtcacatcattgagatgcacccatatttcattctcatcacagaaagatagcaaaacttatttttaagatcagccaggccaggtcgggcacagtggctcacacctgtaatcccagcactttgggagactgaggcgggtggact

SEQ ID NO: 8193 - DNA, 589 bp, Homo sapiens
catacaacagcagcatacttattaccttgaattggtgatttaatagaggcacagctggtagcacaatacatattgtttaaactatttgagcacatctggtcatatcctattaaatcatttaaatccaggtaaaattggggacctccccacgtccatgggaattatgacagaaaactttccgaacagcaaaacacatgcaaggagacacagtaatacctacagaaaaaccttactagtattcaagttaaattaggtatttgttggaccctgggataaatgtggaaattgacaaacacaattaaaagacttactttggccaggcgcggtggctcaggcctgtaatcccagcactttgggaggccgaggcgggtggatcacaaggtcaggagatcgagaccatcctggctaacacggtgaaaccccatctctactaaaaaatacaaaaaatcagccaggtgtggtggcaggcgcctgtagtcccagctactcgagaggctgaggcaggagaatggcgtgaacccaggaggcagagcttgtagtgagcggagatcgcgccactacactccagcctggacgacagagcgagact

SEQ ID NO: 8194 - DNA, 378 bp, Homo sapiens
aatgggtttactaaatatttttagacaatttcttaagtatctacttttatttgcatacagtaagttaggaaagacatttaatgttcctcatacacctgctgtgttattttgtgtgtgtgagacagagtctcgctctgtagccgagccaacctccacctcccaggttcaagctattctcctgcctcagcctctcaaatagctgggattacaggcgtgcaacaccatgcccggctaatttttgtatttttagtaaagatggagtttcaccgtgttggccagactggtctggaacatttaatgttccagaggcggaggctgcagtgagccgagatcgcaccactgcactccagcctagacgacagagcgagactctgtctt

SEQ ID NO: 8195 - DNA, 315 bp, Homo sapiens
aaaagcttggcccagtgtaggccctaaataaatattttctgaaataataagaatattttgggctgggcacggtggctcacgcctgtaatcccagcactttgggaggccaaggtgggcggatcacaaggtcagaagttcgagaccagcgtggccaacatggtgaaaccccatctctattaaaaatacaaaaattagccaggcatggtggtgggcacctgtaatcccagctactcaggaggctgaagcaggagaatcgcttgaatgtggcagggaaaggttgcagtgagccaagattgtgccactgcactccaacct

SEQ ID NO: 8196 - DNA, 401 bp, Homo sapiens
acattctgaacttccgtttcctcatctggaaaataaagctagtactgggaaatagtcataatttttacaaggattgcattcaattaaaacatctagaacatactgcagctcttactttaataagataagaaatcctctccaggtgggtaggagtgaccgacagcaaggagtcatggactggagaaatgcctggagtccacagggcagaggagcttccaaatatttggtttaggacagagtcagacagtcatatagcctccagtcgcagacaggagctcaagtattgaacaggaaactgaggcagaaattccaattctgaacaagatggaggcgacagggcacggatttggcatgcagataccccgggctccctccgtctccatccccatccccccatccct

SEQ ID NO: 8197 - DNA, 477 bp, Homo sapiens
atatcctaagctaaatatgtaggttattcattctattagaggaatatgaagtccatgttcttagtgaactggcacattgagacatactgcctgatgagatgggctgccaaattagtaattgtacttttcaatgagatgaagaaacatctatcttttttttctcaacttagtctgaaaaaattttatgtcattggtcactgaaataacacatattctttgtacaatacaaaaaacacataaagaggaaaacaaaagtcaactagtatcttattttctgttcacattattttagtgttttgctttttagtgcatcttcaatgcctttgtatttgtttatatgataatatggtataataatatagtatcttgagctgggtatggtggttcatactggtaatcccagcactttggaaggccaaggtgtgaggattgcttgaggccaggagttcaagaccagcctgggcaacatagcgagac

SEQ ID NO: 8198 - DNA, 629 bp, Homo sapiens
aaaggcaaaaatctcataaatctagtttaaaacacagcaaaacctggggggtggggagaagctggcaaaatgcatataaggcattaatagataatacagaaagacctccaagaaatcaatacaaaacatttttagaagtccattttaacttctgtcaacattagcaggacatctaatttgaatacccactactgtgctcattcgagaaagttcaataaatatcttttcatgcctaacatgtactaagggctagagagatcagtataaacacaacagatgtgtaccactctctcaggtaacttacagtttggatttgattcttacgtgataaaagcattccattataggatcatctctctgtgcccacagtactaataaataattctaatccatttgtttatttatttctccatagttctattatgttttccattgttttggaaatattataattctcatgctacagggtcccacaatggggtaatgtatatttttaaggaatatttcctgtttcttaattcatcatacttttaaccaacttattgggctcacattctgtaccagtctgtaatatatgctaggactataaaggtcagtaaaggtgattcctgttctcagggaatttacag

SEQ ID NO: 8199 - DNA, 434 bp, Homo sapiens
agaatttatgcccttgcctgactggctgccttatccaattcagcatgctggaacttaaaaatattggccgggtgcagtggctcacgcctataatcccaacacatcgggaggctgaggcgggtggatcacttgaggccaggagttcgagaccagcctggccaaaagtggtgaaactccctctctactaaaaatacaaaaaattaccggggtgtggtggcagacgcctgtagcccccgctactcgggaggctgaggcaggagaatcgcttgaacccaggatgcagaggttgagtgagcggagatcgcaccactgcactccagcctgggtgacagagcaagactccatctcaaaaaaagaaaaagggggggatactggatcatgagcaaatgtccactgatgctatcagcacggcgatggagactggcccatggatg

SEQ ID NO: 8200 - DNA, 51 bp, Homo sapiens
gcacatgagtgtacctcccgttttctgcccagcacactccctggtgcactc

SEQ ID NO: 8201 - DNA, 615 bp, Homo sapiens
gtatttatcttagctaagtgcctgtttaattgagtagagtgatatgtgtgaaatgtgtgtagaagtgtgttatgcgtatacatgtggtttagtgacgtaagttgaaactgtgtttaacagagttctgtatgtgtgttaatgagtttattgtgtgtaaccaacattgtgatatatgtgtgggacattgggtttaacatgtggggtgcatgttctgcttggtttaataatatacgttggaacttgtttaatacaggtggttcatgtgatacagaaaataatatttgtgaaagagtatgttaaccatatggatgcacatccttcacactttagtgatatatactgaacctctgtgtttagtgatatatacgaaccactgctaagctagggaggtgtgtgtatgtgtgtgtgtgtgtgtgtgtgtgtgtgtgtgtttgtgtgtttatgggataaaaaatgtgggccgggtgcagtggctcatgcctgtaatcctagcactttgggaggctgaggcgggcggatcacctgaggtcaggagtttgagaccagcctgaccaacatcaggaaaccccatctctactaaaaatacaaaaattagccgggcatggtggtgtatgc

SEQ ID NO: 8202 - DNA, 647 bp, Homo sapiens
ggagaaggaatcactcagtgttatttgcttcatgctagttcattcatatctttcttcacgctagtgtgctgagataactgaaatgtttgggaggatggaaacataggctgctaattctgaaaccagtgatgaagacaataaattgctcaggtttcttagcttggttctgcccttagctcctccaaagaagaatccaatgaaagaaatgtgagacataggaatactaccactggagagaaaggtgtgaactgaactcaagatggagatggagttgtgagctcttttatgattccactctccaagagaggtgtggactatcctctatcagaatccccctgggttgggcctcacatctgaacactcttcttgattagtgtggaactgccgaagtcaggatttttaaggcataataatactatttaacagtactcaggccgtgtgcagtggctcacacctataatcctggcactttaggaagccgaggcaggcagatcacgaggtcagaagatcgagaccatcctggccaacatggtgaaaccctgtctctactaaaaatacaaaaaattagctgggtgtggtggctcgtgcctgtaatcccagctactctggaggctgaggcaggagaatcgcttgaacccaggagttag

SEQ ID NO: 8203 - DNA, 644 bp, Homo sapiens
  misc_feature 406: n = A,T,C or G
ttcatgcatttgacttattaaaacacttctgaacaagatatatgatttctggtaggttttagttacatttacatgtgtttatgttgtgtgtgcatgtgtgtgtgtgtgtgtgtgtatgtatttttggtgttactggcataagttgtgctatgcaatctaggagattgaaactaattatagcagtgaggctaacaaagtgtgaaaagtgtgaaagccatgaatctgaatgaaactttccacttctgtctatgagtttttataaaaactctgatgatattttcacccaaaatatgtgtttttcttattttaaattgttagcaagctaaataaatcatcctgattatttttatattacatgggttaattaatacatttttgcaaatgacatcaattcctttcttctcgngtctcttcttgtcctttttgcttccctctacaaacactcaatgcatattatatgtttttatatacacacatatggaccatggttctaggtgttaaacacacagaggcaaattaaacttcaatcctgacctcagtgaaattacaactcaatttgtaagcatcatgataaggataagtaaaagattatgtgaagtaattcccaagattgtttatggttttatgctacacagcacaataag

SEQ ID NO: 8204 - DNA, 264 bp, Homo sapiens
caatttcatgtcaggaatttatcctacattagtgcttacatggggcacaaattccagtgtactagagtattcactgcagcattgtcagtaattacaaagaactggaaataaccttaatgtctatcaaaaaagacctggttgattaaactggcacattcctcaacaacaacaacaacaaaaacagaatgctatgcaagctgtaaaaaagaatgagaatagatccctacgtactgatatagaatggtctgtaagatattaaatggg

SEQ ID NO: 8205 - DNA, 143 bp, Homo sapiens
ggaggatcttttaatgtaatgacccaccttttcttgttaggtcggccagtggttcctttaccggttcccctacatcaagctccaattcagtttctggccaggcacagtggctcatgcctgtaatcccacacttggggaggctc

SEQ ID NO: 8206 - DNA, 167 bp, Homo sapiens
gaactcctgacctcgggtgatctacccacctcggcctcccaaagtgctgggattacagctgtgagtcaccatgcatggcctggaatctggatttttttcacaaactttctcagagaattacacctgactccactgaattctacaagcccagattttctatttttgct

SEQ ID NO: 8207 - DNA, 562 bp, Homo sapiens
ctccgtcttgccaggcgagtggcgagtcttcagcggcagaacgtggtcctcccttcggggtccctgagctgcaatgcagccgcttgaggctggggacggctccaaggagcccccagtcaccaagaagcagcctccagaaaggccgctgcgggttccggggaaaggcgggctgaacgtgcattcccgtgagactgcctggaggggcgagctctgctgcggggcagggggtgcctgatgtgggctgaggcctgtgcagagaagccaagaggacacctggaccctccgccgagtccagccaccagagacccagagccccccacgaaagcagagcctcgggccgggccctgtggctcacgcctgtaatcccagcactatgggagcccgaggcgggaggatcacgaggtcaggagactgagaccatcctggctgacacggtgaaacctcatctctaataaatatacaaaaattagccgggcgtggtggtgggcgcctgtagtcccagctactcgggaggctgaggcaggagaatggcgtgaacctgggaggcggagcttgcagtgag

SEQ ID NO: 8208 - DNA, 303 bp, Homo sapiens
cccagagagggcaggcattggagatgagtccaaacccaactcctgtcacctgtgagctgtgtgacccaaagaaagttatgtaacctctctgagcgtctaatgtcctctgcaaagcatgaagatgaaaatcctttccaagggttatgtgtgtcttaaaacactttcgaggccaggcatggtggctcatgcctgtaatcccagcactttgggaggccaaggcaggaggatcacttgaggtcaggagttcaagcccagcctggccagcatggtgaaaccctgtctctaccaaaaaaatacaaaaat

SEQ ID NO: 8209 - DNA, 577 bp, Homo sapiens
atcagtaccagctagggtaaacactactctagtatcaagtgtgaggtggaattagtaaatgaccagcctgccaacatggcaaaaccctgtctctactaaaaatacaaaaattagccaggtggcacatgcctgtaatcccagctacttgggaggctgagccaggagaattgcttgaacccaggagacagaggttgcagtgagccaagattgtgccattgcactccagcctgggcaatacagcaagactctgtctcaaaataaataaataaacaaataaaaaaacaaacactacattctactagtcttcatcaattgacttcattcatctccaccttccccaactcttaacttccctatcttcatcttgatggcaaccaatgtaacacaatatgaaatttttacttttaaaagttgacattaataagagttaaaaaactaaacatgcggccaggtgtggtagctcatgcctgtaatctcaacactttgggaggccgaggtgggtggatcacctgaagtcaggagttcgagaccagcctgaccaacatggtgaaaccccatctctactaaaatacaaaaa

SEQ ID NO: 8210 - DNA, 377 bp, Homo sapiens
catacttttcaaaaatgttcctgcctattgtaagttccttgtgagcagtgactgtttcatggtattgtcacctgcacagttcctggcatttattcatgccttgataatgttaatgaagtgaatgaattaatatttggatgtctgtatccttcacaataattgtactgaacaacggcggtatatatatccatcgaataattcctgctcatagtagcaagcctccagtgtttcacctccaaaaatgtccagaataacaacagctatccttagtcaacattttccattaccaaacatttggctaaggaattcacactattgcttcatctgtttgcttcaacaatcccatgagcttagatagagcaacttgctcaaggcta

SEQ ID NO: 8211 - DNA, 407 bp, Homo sapiens
tgtggggtacattgtcaagccacaaacataacctgctctgtaataataccctcctacattgttatcttgctttggcacagtatgattcaagtcttaatcttaacactaaaattaagtggtttcactctattaaaggcatcatcctcaactgaaactcactaaagcatatacacgtcacgtggaacagctgaacacaaagctcttaatctgaagttgacctatttagtaaacctatagctcaaaatttgacctcatcacctcagaaaatcagggataaaatctgtctttatattgtttcaggtacttgggtatcagagacattatttgtttatcaagacctaacaaaacactttcttattttttaaaatttctgtgtgtgtgtgtgtgtgtgtgtgtgtgtgtgtgtg

SEQ ID NO: 8212 - DNA, 597 bp, Homo sapiens
gacagaagggcagctctgccacttatttgtcacaagcctgggtaacttgctgaacctcattttccattttaaacatctgtgacaagggtaatgagagcgcactcattgaacatctagtgcctgtgccaggaactgtgctcagcactttatatgaattctctcatttaatccccaagactgtcattacccccattttatctgaacccacatctgtctggctttattatcctggcagcactcgctggtggaggctgcaggaggatgttttgcaaagcacccacattcaagctttcccatctgtcaccagaaatattctgcaagcatgctgaggccaaacagccttcccccttcctccttccctgccggcaggcagccccgcctttaccaatctggcagagtaggcccctgggacaagaatcccagccccatctcactcacggctcttagaaaagacagtggctggccaggcgtggtggctcacacctataatcccagcactttgggaggccaagcaggtggatcgcctgaggtcagaagctcgagaccagcctgtctaacatagtgaaacgccatctctactaaaaacacaaaaattag

SEQ ID NO: 8213 - DNA, 549 bp, Homo sapiens
tccggctgcgaggcgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggagatccattaaatctctagtcatatgcatgaaattattagaggtatatgtatactgaaaaaatgaatttagtgctgaattttcatttgcctttcctatatatagtcctctgtattaatgtcagcaatcagattaaaactgaaaatttgacttcctctgcttcctctaataaaatctcatttttaattccttattagagaattatttcagcaatgaaggataatcatattttaaataaaaaactgtctcttatcagaaagccttattgctttaaatcattcttaaagatgtatttgaatgccttgttcaccagcgagaataggtactacaaggaaattcagaagaccaacaagtgggtcgggcacagtggctcacatctgtaatcccaaca

SEQ ID NO: 8214 - DNA, 646 bp, Homo sapiens
gaaattaggtgcttcctctatattcattactcatgcgtgtttattaaaatttagttatataaatgagaacttgacacattaacaagtagttatatggctgttaactcaatttctctttaaagacttgagaaaataagggaaaaatgaaagttaaaaagaagaccctatttattgaactacagccatttcattctcatgaaaatggtatgttcatggccaatgcagttaatttactggtgaacaaaagtagtccaaactagttcattgaaataatatagtgcaaatccactgacctcagaaataacctcagaaacttatatctaagcttaaaaggggccgttgtctgggcgcggtggctcatgcctgtaatcccagcactttgggaggccaaggcgggtggatcgcctgaggtcaggtgtttgagactagcctggccaacatagtgaaaccctatctctactaaaaatacaaagaaacttgctgggcgtggtggtgggcacctataatcccagctactcgggaggctgaggcaggagaatcgcctgaacctgggaggcagaggttgcagtgagccgagattgtaccattccactccagcctgggcaacaagagtgaaactccgtcccaaaaaaaaaaaaaaaaaaaa

SEQ ID NO: 8215 - DNA, 533 bp, Homo sapiens
  misc_feature 432: n = A,T,C or G
actttccctgaatcattgatactttccatgatggagggtgcagcctgggatagtgctggtggggccaggaagctgatggaagctggctgatgcatgggcttgagctggagcctgccttgatgggtggtggacacccctgaccactggcggtgaggagctctgccatggtgctcatgctaaagtggcatcgactcccttcctgtggcggggctccctgccatgtgccagctctgtgctggccacatgacatgctatctaatttaatcttcccagtggccctgttttacagatgaggaaactgctgatgctcagagaagttaactgtcttgcccaaagtcacagaattagtacctggtagatccaggattttaccctagaccagtcttacttcacaggctgtgccgtttctcctaccctctgtcacctctactnggtgggtgcctgaatgtgcctggctaagcctgggcccctagcattgcctgtctggctccacacccccaccaagctgtgtcttccctctccctgcttggggc

SEQ ID NO: 8216 - DNA, 598 bp, Homo sapiens
agtggtagtacaaagaatggtaggataacaagaaattagacttttgcaagtctctgatattttacatgaagtggtgcattttaaactaagtagactgtagaaaaacgtgcagtagtccagacacaggggctcacacctgtaatcccagcactttgaaaggccacgacaggtagatttgaggccaggagttcaagatcagcctgtccaacatggcaaaaccccatatctactaaaaatacaaaagttagccgggcatggtggcacttactgtaatcccagctacttgggagactgaggcacaagaattgcttgaacccggcaggcagagcttgcagtgagccaagaacacaccactgcactccagcctgggtgacagagcgagactctgtctcaaaaaaaaaaagaaaaatgtgcagtatatattatagttacaaaagcaacaacttaaaaaataatacaagcaagtacagttcaaaagtcagtagagaagttaatatactaaaattgaacactaagaaaaattcaagcaatgcaaaagaggaaaagaacggaggagcaggaattttaaaagaaatggaacagatacaggccgggcatg

SEQ ID NO: 8217 - DNA, 396 bp, Homo sapiens
  misc_feature 185: n = A,T,C or G
gtgctacctgacacctattgggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcanagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctact

SEQ ID NO: 8218 - DNA, 428 bp, Homo sapiens
gaagcacacagcctcgctgctgtggtgctgttacgcagaacgtgaggctattcctgaggaaactggcaaacccgagtgggcctgtgcccttcaaaaaatgtcaaggttgtctgggcacggcggcctgtaatcctagcactttgggaggccgaggcaggcagatcacctgaggtcaggagttcaagaccaacctggccaacatggcaatacccagtttctactgaaaatacaaaaattagacgggcgtgacggcgcatgcctataatcccagccactcgggaggctgagacaggagaatcgcttgaacctgggaggcaggggttgcaaggagctaagatcacgccactgcactccagcctgggtgacagagcgagactccatctccaaaagggaaaaaaaaaaaggcagggtgcgggggctcatgccta

SEQ ID NO: 8219 - DNA, 452 bp, Homo sapiens
cctgcgtttccctgttaggaacctcggtggtagccggagctctgagaaacccctaggcagaactccttgcctagtttgtggcagaaatcagggaaggaaaggcaaatttcaggtctttctcacaataaataattaaagataggtagatttgattaatggatggatggatgaaacgtgggagtctacgggcaaatatttatcagacactggaagtgtaagttgtcacaaagattatggagtgcacctgtcttatgaccctgttattttatcctagtatatgcactagagcatattttctaactgtgtaaattgaaggctcacaaattagtttagtgagagaaaagataacggattggaagagaattaccatattcattagttgtgtttttaaatttttaaagtaaaatagagacatgatttttttcatgctttcaaatgcatctataaaaaat

SEQ ID NO: 8220 - DNA, 462 bp, Homo sapiens
gttgagactgcaatgagccgagatcatgccattccactctaacccgggtgacagaatgagaacttgtctcaaaaaaataaaaaaataaaaaaaaaatgtatcaaccaaagtcatggagaaccaaaccaagttttgtctacaaccatgattcttacagtttttggtttcaggactctttgcattttgaaaaataactgaacacccagaagcttttgtttatatgaattttatctatcagtatttactatattagaaattcaagtgaggaaaaatttaaatatgtatcaattcatttaacagaacatgagtaaactcattacatgtaaacataaatgacttatttttaataaaaaacttattttccaaaccacaactaaatatataccaaaggaagtctacctgatgaactaatcttataatgcaatcaaaacaaaacagctgaccaaaaaacaggctggggcg

SEQ ID NO: 8221 - DNA, 338 bp, Homo sapiens
actaaagaattatggtcgcttccagttgtaatattttttgtcgctgaaatatcatttaaaagttacatttcaaaatgtatgtatacaactataatatagccattggaaatatatattttaaatgttcagttattttttacagtaatctgtcatgcctgtgtcattgttgacatgaaattaatgttagaatcaatgcaagataatatggatcaggactgaaacagaaataagaattctaacctcataaaagagaaaatgagaagagtgaaatttcaaattccttcaaatggaaggcatgaaaattctcattagctctgggtactaatatagtgggatag

SEQ ID NO: 8222 - DNA, 451 bp, Homo sapiens
tgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaattaaacatcctgtataacctattttattctctgccaaacaattttatgactgctgtttttactctttgtgatgaaaatgggatggagaagataaggttctttgtccttatggtggtatttattatcatcctccatcaatgcagattgggtaaatagagaaaaat

SEQ ID NO: 8223 - DNA, 300 bp, Homo sapiens
tatacatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagaccttccccctaataccctggatgaacttatcgatgaacttggtggccctgagaacgttgctgagatgactggccgcaa

SEQ ID NO: 8224 - DNA, 414 bp, Homo sapiens
ggcacgagagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgc

SEQ ID NO: 8225 - DNA, 288 bp, Homo sapiens
aaaataaaagtaaattctaggcaagctaaagagtgaaatgtatcatcacataggaggaagtgggggaaaaaagtgaaatgtaagaaatgaaatgataagaagaacttagtgggtattcgtttgattttggaggcactctaggaaaattctgccagattgtactacatttaaaaaaaattttttttaacttttgtgtgcttcagtttggtcatagacaaatgaaaaggcacatcacaaactaaaaagaaaatcagttcctatatatgataaagggttaatatgttttta

SEQ ID NO: 8226 - DNA, 413 bp, Homo sapiens
ggcacgaggagatccaagtggtttagaaggggatgattgctggtgaaggttctgaacatggtgacaggtgggaggctgagcacacactcgtacaccgctggcaggaagagaaatgacttttctggactacaatttggagataacacaaacattaaaaagaagaaaaaattgtatccctttttgactaagcaattctaggattgttatttttttctcctgaggaaactagcatggatgttcacattcaggtgtggggatgtttatcaatttgctattttagaaaagagaaaaaaagtttagcatgtcacaagataattttcatcaatatatggtacatccatttagtgaaatgctgtacagccatttaaaaagatacagaagaggccaggcacggtggccttacttggctaatt

SEQ ID NO: 8227 - DNA, 583 bp, Homo sapiens
ggcacgagagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgaga

SEQ ID NO: 8228 - DNA, 527 bp, Homo sapiens
gaattcggcacgagcacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtgaagacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctg

SEQ ID NO: 8229 - DNA, 499 bp, Homo sapiens
cataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagtttggtggggatctggcaaagaacacctgggagcagccagcgggcagcagaccccagagtagcagggaagacaagcacttcaaagaggcagcgtcagccaggggcagtggctcagctgtaatcctagcactttgggaggccaaggatggcagatcacctgaggttaggggttcgagactagcctggccaacatggtgaaaccctgtctctactaaaaataaaaaattagccaggcattggtggcatgtgcc

SEQ ID NO: 8230 - DNA, 516 bp, Homo sapiens
  misc_feature 457: n = A,T,C or G
tcgcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattntcatggatacccttaatttcatgggcatgcctaataatgatctatgttctaactggagc

SEQ ID NO: 8231 - DNA, 246 bp, Homo sapiens
ctgctcatggaaacacaatgactatatctaagtagacttaatatattagaaggatgggtatgagaatgtgaatgttgcaaaggtaaatccttatcttccgtatgaagtatcaatagcatgcccaaaaaatgaactatgtaaaagaactgtaaagttatcattaaagatagagtggagtatagcaaatgaatcagctaaatatttgaaaatgggtaccctctggggagtggaagatacatgtatgta

SEQ ID NO: 8232 - DNA, 521 bp, Homo sapiens
ggcacgagcttgagagaatagatctagatgggtggggcacggttctggggaatggaagggccaaagaggaaagtgggcaatggtggggttgagaacgcagcttctggactcagcaggcctgggttcaaactctgttaatcactcctgttaatcccagcgctttgggaagccaaggagggaggatcacttgaggccaggagttcaagaccagcctgggcaacataatgagattccatctctacaaaaaataaaaacaattagccaggtgtggtggtgcacacctgtagttccaggtacttggaaggctgaggcaggagaattgcttgagcctgggagtagtgagtcatgagtgcagtggcacgatcatggcttactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctga

SEQ ID NO: 8233 - DNA, 573 bp, Homo sapiens
ggcacgaggcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatatt

SEQ ID NO: 8234 - DNA, 468 bp, Homo sapiens
ggcacgagggggccatagcctctattcctgcccagctgtggatcctcagcttgccatgttaggtacactggaccagcttgtggagccatagcccaggagctcagggacattgagtgcaggtttcttactcctacctgctggccctgtggctgtccctggtggccagcccagctgcagcaaaacctacaaagcctccagccatggtaggcgtcttggacctgccccagtcagctggggcttgggctgctaggggttttggcacacgtccatgtttggcggagggtgtgccttcaaaccctgaagggcctaatttcaccattctttctggctgcccaagggaacttccctgcttttctcccttgctgttggctggataaaactggcaatcagaaagtcaagagctacagctgatggtcatggtgttcccagagagtcaggaatatccatggaagctgagcagatgccctg

SEQ ID NO: 8235 - DNA, 555 bp, Homo sapiens
gaataacaacctaactactacccctcaacctcacccccaccccaggaaaagtaagtctttttctaacgatccaccagattagggttacatttaacagtaactagaaaggttaattgtaaccttaatcagaaagattaatttctgtcctttcagtcttctttctgtgctcataaataagcattgattcttttaatcaacctgcgcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttagtgagtgcctattatgtgccaggccttccttcagtgctggggcccttcagcaatc

SEQ ID NO: 8236 - DNA, 112 bp, Homo sapiens
ggcacgagatgaggtgtgaagccattaaatccgaagaagagctcaaagaatgagaacgtgattgcatgaaatgttcatccagaaatcttgggatataggagaacagggggag

SEQ ID NO: 8237 - DNA, 585 bp, Homo sapiens
ggcacgagccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaccactatgagaagattataggaaaaacaccaagactagaggactctgggttccttttatgcaaagtcaactcttctgggtcacagttacccagcaacaaaaataaagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcagggcaactcagtgaactaaatactatgttctg

SEQ ID NO: 8238 - DNA, 87 bp, Homo sapiens
cctcgtggaggacacagcagcatgggacagtcagggaggtcccggcaccagaagcgcgcccgcgcccaggcgcagctccgcaacctc

SEQ ID NO: 8239 - DNA, 467 bp, Homo sapiens
ttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcg

SEQ ID NO: 8240 - DNA, 545 bp, Homo sapiens
ggcacgaggtgacctttaaaaagcaaaaaaaccaaaaaccaaccaaccaaacaaacacaaaaaaacaaacccacaaaaaatgaaaaaacagctacttctgaaacacataaaagtatcttgatcttttaaaaacaggtcctgaaactacagatccattgctgagactactcgaaaaactgtaaaacatgggcattattttaattcgtgaacaactgaaaagattcaatggagtgccatgtggtcattttagtatgtgagtcaaagcagaataatagggaaacattaaatctctcctttacagtttaagaggttgaaagcaaaaggaaagtctgaaaaaagaacaggggaggtttggttggtaatgtttttggtagaactggttatccttgttcgtatttagtaggtgccttttagtcttacgagagtagcacccacagatggccaagttcaaatatcaaagaatcagaatgcaaagtacaactggaaattcacactggaattcaactggaaatatgcatcaaaaaatatggctctttggaaatctg

SEQ ID NO: 8241 - DNA, 291 bp, Homo sapiens
cactccaccctggacaacaagctcaaaactccgtctcaaaaactaaaacacacaaaactacattgaactgtactgaaatagtacagcacacccactaaaaaaagctagcattgaaaagattgacaataccaagtgttggtgcatctgtgaatcaatttgaacccgttacattgctgatgcaaaaaggtacaacgatttcataaaactctctggcaggttcctgtaatgttaaatatacgctaccatatatccaatcctgtttacccaagagaaatgaaaacgtgtccacac

SEQ ID NO: 8242 - DNA, 568 bp, Homo sapiens
gccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggtaagtttaatgagactctggactctttctttgactcaaataatttgacttaaagagttataaaagagtgagattcatttaaccactaagtatttactgaacatgtactatgtgccaggaatggcacaagtacctaagtatcaggccgagcatggtggctcacacctttagtcccagcactttgggaggctgaggcatctttactaaaaatatgaaaatcagccaggcatggtcataggcacct

SEQ ID NO: 8243 - DNA, 337 bp, Homo sapiens
agccacattggctaaaatgactgtagactgaatgggctcataagcttgttcttttatttacaacctacctccctgtctcttttctttccttcttcccacatggaacactgaggaatagccttggtaattcaacgccaagcctgcccccatgacttctgaccccagtctactccactgccagcctcttgtccccactttgcacacagcttatcagcattcacatggaccctactgccctttccaacttgcaaataatggcctcactagtgagccatggaattaattagtgggtagtgaccaatattaaaaattttacttcacagtacatctcgcatag

SEQ ID NO: 8244 - DNA, 325 bp, Homo sapiens
tagcagtagtagtagctacctcaaaggactgtagtgaggagtaaagttacatacaaagcacacagaactgcacctaactcagagtatgtataataaaagtattagctaatattactgtagtggaaaactcccttaattcaagtgattgtaccttttttactcaaatacctcctcctcaccctgcatctcctgtggctccatgaaatcaaggccctgcccagaacagtctctgtgccaagacagcttttagctcacccacaccactttatttacagataaattctgacatacagatgtgggtttcaaccttggttcctgtgtcctc

SEQ ID NO: 8245 - DNA, 315 bp, Homo sapiens
taagtgtttataaaaggatccccttgtgtcagggagatccttcaggccatttcaaccattactgtattttatttaatttgcttaattgatatattcttagaaaattgtgtcagtgaatttttttaaataaaatccaatttttaaaaaccagtagacccaattttttaagaaaaaaatccttgtcctatttacttttgataatattttactattcggggtatggtatctgtaaaataaaaacataattataatgtgttacttggaaggattgcatgttcaagataactgaagctgaaaatgttaagttgaaaactt

SEQ ID NO: 8246 - DNA, 374 bp, Homo sapiens
gttataattttaagcaacataaacaagtaagaataaatattttagaagtgcgatgttatatttcttggtttaagtggtagattgatatatgttttctatcatactaataaacaacttgtaaatatcaaatgcttcataatttagaaatgtaaaacatgataatcaaatccaaaagtaatctaacacatttaaaaactaaacatatttaggccaggtgcagtggcccaagcctgtaatcccagccctttgggagaccaaggcaggtggatcacctgaggtcaggagttcgagaccagtctgaccaacatggagaaaccctgtctctactaaaactacaaaattagccatgcgtggtcgctcatacctgtaatccc

SEQ ID NO: 8247 - DNA, 78 bp, Homo sapiens
aaaaaaaaaaaaaaaaaaaaaaaaaggggggcctttttttccggaacccccaacttaaaaaaaaccttgggggggggg

SEQ ID NO: 8248 - DNA, 111 bp, Homo sapiens
ggttgatgggaatttgaaatagacatcctatctaaagggcatcttgagtatatctaaatttaaaacacacgtaccgtttgacctaataatcccacttttttttttcttttg

SEQ ID NO: 8249 - DNA, 70 bp, Homo sapiens
gtgcaagtgcaaggctccttctcctcatgctcactgcctgctggggaatagggtactggggacatacccc

SEQ ID NO: 8250 - DNA, 369 bp, Homo sapiens
tatcctcctcagtgatacatcatgaagttgtgtgctttgcctaaaatgcccagttacctgaaattgtataaattcttgccaaaagtgtttgaacttaatacaaacttcccatctcttacctcttagcactgtgctcatcttgaggggacatagtcccaattttgtattttatataatactgttagtgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatccc

SEQ ID NO: 8251 - DNA, 163 bp, Homo sapiens
gagtggggaagggacttctgcatcacggcatagcatatgtttctgagatcactggaagaagctagcagtgccaggagcctaaagccagctcactgtttggtcgtccagcggagcaggtacagctcacaatccctaaaccagggaaacctggctgacttccact

SEQ ID NO: 8252 - DNA, 385 bp, Homo sapiens
aagctttcattgctatcagataaaaagagttcttgatgaaacagactctgactttattcctcttttagttcgagccttcatgtaatttctggatgaaacacctctactctgtcctcatatccttactttcttactgtttcttcttatttgtttgccttttattcttttcctaagaaattgatggtgtcagtatctttattctagatacacttatcttctgctatcttgtgctgacacatatttatttccaaagtgcctctgctaaaatcaaaactatatcctcagaactttcaaaaatttcagtttacctgcccaagtcagaaatgtgctttccttgtgctttttcctatttctccttttataggagtccctttgttttaacctt

SEQ ID NO: 8253 - DNA, 360 bp, Homo sapiens
attccctattagtatgacatttacttttggttattagtaggtagtcattaacatgtttaagagtttccgctattcctgttttatagtgttattgctagaagtggttcctgaattttataaaatgccttttcagcatctattgataaaattgtatgattttttttctctttaatttgttgatgtaatgaattagaatggtaggcatttgatgtggaaccaaacttgtatttctggaacaaatactacttggtcattgtgaaataatgatttgctacatgagtggattttatttaccagtatttaatttagaattattgcattctcattccaaagtacaattggattttggccctctgatgc

SEQ ID NO: 8254 - DNA, 300 bp, Homo sapiens
aattccgttgctgtcgatgctcccaggtctccagtgtcacctctcggtacagtgtcctctgggccaggtccagctgttcccactcctcctgtgtgaatgccatagccacatcctcgaagcacacagatgcctgaaacagggcacttgttactgctcagagaccccaggtcctcatgccctcacggaggtacctgttaaggcctaaatgttggtgtccccccgtaaaattcatacattggaacctaatacccagtgagatagtgttaagaggtggggtctttacaaggcaattaatgtcct

SEQ ID NO: 8255 - DNA, 220 bp, Homo sapiens
gaggaaggaaaaatgtgcccaaggccattatggagaacaaacacctatgcagttggagaatgctgaagacacccaagggtgttgtcctctccctcctgagagaagctaagaagatccaggcttagagtgctacagaaatagagatttaggatagaaaaaaaggaaggatttcctaactaccaccagggctatgaggcactgatatgacttacttgtgaac

SEQ ID NO: 8256 - DNA, 345 bp, Homo sapiens
ctggccaacatggagaaaaccccatctctactaaaaatacaaaaattagctgggcgtgcacctgtaatcccagctactcgggaggctgaggcaggagaatcgcttaaacccaggaggcggaggttgcagtgagccgagatcatgccactgcactccagcctgggtgacagagtgagaccccgtctcaaaacaaaccaacaaaaaacagagccaggtgtagtggtgtgcacctggaacataacttctcacaacgctgccgtgggaagactgcttgaacctccaggagcgcgaggaacactctggtcataccaaccgaggtctcaaatttcaaaggcatttctattc

SEQ ID NO: 8257 - DNA, 341 bp, Homo sapiens
tggatcagtgactcattgtgtgaatagggtcacagagaatccctaaaccattgcttttcatatcaggagtccaacagtctttcaggttgcccctgactgagggctttgagtatttagtggagttttctggtaaatcatagctattgtaatttaggtttcagcccaactagatgcttcctactatccctggtaaggaatggaactggctcacagtaaatgtagctgtttagtaatagatgtagatattcttattatcctctctaggtcttctattctgatttcttatttttaagattaagaatttaatgtctagaaaagttaagtgaccatgtcatagctat

SEQ ID NO: 8258 - DNA, 450 bp, Homo sapiens
  misc_feature 23, 37, 39, 40, 41: n = A,T,C or G
gtactggcttttgaaaagacccnacgaaagctcgcgngnnnttttgtgcgaagcggcctacggtttttagaagacaacagaagggtggtaaaatcactgaggctttaccaaaaggttatggggacaatgcacctaaaaaaatcagcagtttacaaatggataacttgtaacaagggaaaagatgacgttaaagatgaaggctgcagcagcaggacatccacatcaatttgcaaggaaagaaattaatcctctttgtgccctaactgaagagtcagccaggtgtggtggctcatgcctgtaataccagcactctgggaggtcaaggcaagtggatcacttgaggtccagagtttgagaccagcttggccaacctggtgaaatccattctctactaaaaaaatacaaaaattatccattcatggtggcgcacgcctatatgtccatctactt

SEQ ID NO: 8259 - DNA, 541 bp, Homo sapiens
gagacagcccttctgtgccccctgcctgggcaaatgacacctccacccacataggctcaaagctggggagcaagatatcctccttaccactgccctctcccaccccccacctttcccaaaccctcacagggcacagcacagactactctgcaccccaatatccactctccccttcttccaaagcaataggacttccaatacgtagctgggcacagctacccagaaataagaccacatttcccagcctcccttgtatataggtgtggccaaggggttaaattctagccaataggatgtgtgcaaaagtgaactgcgcaggtccctgcatgtgtctctaagggaaagggcaggtctacctccatcattagcttcccttctcctttccccttcctggcagttggagtgtaggagagggtgaccatccgatttggacaataagagcaaagacaatcgtttagggaaaatggagcaacaaggtaggaggagcctgggtccctgatgccttggaatagccaaaccagagctgcgacacttacttaca

SEQ ID NO: 8260 - DNA, 341 bp, Homo sapiens
ggctgtacaaagagacagaggctgttagctatggctgaagacagtggcaaaaaaaaaaagggcgtaagaattttgaagctatgttcaaaggtatccttcagaggggatgggataacttcgtgataaaccacatgctaaagaacaacgtggctggacaaacatctatccagaccctagtacctaatacggatcaaaagtcgaccagtgtaaaaaaagacacccccaaaaaaaaaacagttaaaatgttgaaatacctgggcaaagatgttcttcatggggttttaaattattgggcaaaacacgatgttttgactttgagggaagaggaaaagaaaaaattt

SEQ ID NO: 8261 - DNA, 248 bp, Homo sapiens
gctttgagtatttagtggagacttctggtaaatcatatctattctaatttatgtttcagcccaactagatgcttcctactatccctggtaaggaatggaactggctcacagtaaatgtagctgtttaggaatagatgtagatattcttattatcctctctacgtcttctattctgatttcttatttttaagattaagaatttaatgtctagaaaagttaagtgaccatgtcatagctatacagaaaat

SEQ ID NO: 8262 - DNA, 503 bp, Homo sapiens
ataaagccctttccttccacaacttggtgtctgaggggttcttgtctgcggctcatcctgctacagtttctgctaatttttttgacttttatttttcttgtccatctctgatgcttgctttgctactccactttgaggattttgggcagcttcaccctcagccattccaacagtccatccatttgcctcaagctctaggcagtttctcctggttcttctgttcctggcatctaagatttgtcagcagggcctggtttccaggaaccatgcatggctatggcctcctcccacctggagggctgctcctgcacctctgactggcaatggttccagctgcggcccagctgagcacagcaggaatggcagcagcaactggagcatccatgcccagggtcacctagcccagggacaccttagctacaacccagggttgatgtccagctccatgcaccaaaagccaaggccaaccagagcatttcctggacaagatctctcggtctgca

SEQ ID NO: 8263 - DNA, 580 bp, Homo sapiens
aattactttgagcagatgccagtatttcttctcaatgagatttcaaagaataagaaagctaaacacagtattatcaagaattaaatgtgagcattctgcctactttctgcaagtggcctacattcaacctttggaggtatgcttatacgtttaacgactaaagtaacataacataatacttaacagtgccactcaggggttttagctgtgaaaaagcagtggatcctaagaacagtgggcactgaagttgcctgtctctatgtcaggttacagctcaagctgtgtatatgctgcagacgcccaagctgaatttaagagaatccgctctaaaacattacttgctatttagacacatgcttaaagttatttccttttaaaccttaggcagattgtgaaatattcccgatgtattgtctcacaatgcataacaaagcttttcacatattttcagatatttgggaatgtttccatatgtctggcatgcctgtaatccagcactttgagaggtggaagcaggagaatcacttaagcccaggagttcaaaatcagcctaggcaacaaaaggagacccccatctcta

SEQ ID NO: 8264 - DNA, 78 bp, Homo sapiens
ctgccgctttccgagcgagtgtcatggcggccggcgtcgagttggcaggagtaacccacggaactgaggaaagtcatt

SEQ ID NO: 8265 - DNA, 260 bp, Homo sapiens
aaattgctttgctagagtaggttttaacatatgtttttgggtaatggtggcgatgatgcaataaaggacagccgttattcaatttactctgtggcactaaggcaacttgaaaactctctgttgtaacctgacatagagctttgcatatagtaggaactcagcacatgtttggtagattttaagcaattattttttttctgtttgtattagtctgttctcacaccgctgtgaagaaatacccaagactgggtaatttataa

SEQ ID NO: 8266 - DNA, 137 bp, Homo sapiens
cacttaaagaaattagaaaaagaattacaaactaagcccaaaataagcatataaaggcaataataagactagagtagaaataaataaaatagagaattaaaaaaaaaaaaaaagcaaaccggggaccgggggggggg

SEQ ID NO: 8267 - DNA, 445 bp, Homo sapiens
tccacaagactcttgaaattatatattctgcagtaggataattatgttatctaaccagaatagtaatgacacatgcatttaaagctgataaaaatgagtcttgtcaaaaggaagtgacagcccaacttgtcaggccaaacacgctttggcatagaactttatatgctctttaaaatgactttaataaaaacaataagctaaccaatgcaatcaaactttgaaggtaataacaatatcagttatcaattttgtcctctcgatactccttggctagttttgcatttctgctaacatcattggtcctggatgattctgaaacttcagcctacaataccgtaaagtctttactgtatacgttcaacttcaagcataagataaattacaattaaaagtataatcagaggctgggcacagtggctcagccctgtaatcacggcactttggg

SEQ ID NO: 8268 - DNA, 353 bp, Homo sapiens
tacggctccgagaagacgacagaaggggtataaataaaacaaatacatttgaatacagttgaatatacaatatacaaaattttcttccaagtataaaacgaaaataaaatacactactttctttaatagaatagaacattgtaataatgttccattgcatttgaccctcacataaatgctatgaggtagcattaagagataagatttgaggctgggcatggtggctcatgcctgtaattccagcactttgggaggtcgaggtgggcagatcattaggtcaggagtttgagaccagcctgaccaatacggtgaaatcccgtctctactaaaattacaaaaagtagtcgggcatg

SEQ ID NO: 8269 - DNA, 412 bp, Homo sapiens
cgcacgagacacattcttccatttgtcagtaagagtaataatttgactgttttattggattttagcctttttgatttcatatagctgtatcttaatatatcattgtttttaatatgtctacattgaatacttattacttgtgcaatgaaaaataataattaaagatgaaagttaagcctgttaccactttcagagaacaacgtgacgttttggaatttaaaattttttcagtagatttgagaaaaacttgggttaaaatgaagatttatgctcagaactgagattccagggtttaagtctggttttaaagctgtcttcaagattttaatgtattttctgtgtgtataggatgctctcatttctgtttttaaaaatgaaagggatcgctcctgtaatcccagcactttgggaa

SEQ ID NO: 8270 - DNA, 410 bp, Homo sapiens
ggcacgaggcggagcttgcagtgagcagagatcgcaccactgcactccagcctgggtgacagagcgagactccatctcgaaacaaacacaaaaaaaagtttcaaagacagaaagtggaagttacaaggctttttaaggccttatcttgaaagtcaaagcaacatttattttgcattccattggtcaaactcaagtcctaacaggcctaagggggtcaagtaaaaggtgggactcacaggaagttccatatacattacagcttcacttgcagtacagaggggaagggaaatcctactgggacagaacctcaagtagcatacctggttgtatattgtgcctggaagaaaagatggccagaagtatagatctatagatggatggtgattgatggatggtttgactggatggtc

SEQ ID NO: 8271 - DNA, 340 bp, Homo sapiens
ggcacgagactttgcatttgctcgtttcgttcaacttttccttccttctctgcctgccaaagaaactgtaataactgtaataattcttatgactttctcttcaatgacagttatcttcctttaccctaattccttccctcctcatccttcaaatccccttcctcatcattcaaagtctaactcaagctagcctttcctccttattttccccttatctttccaatccgtatggagatttctcacctttcctgatagaggttgcgccagaatggcgaggattaaattgtaattgctctctaatagactgctgtgtccgcccactagatttcaagctctctaa

SEQ ID NO: 8272 - DNA, 590 bp, Homo sapiens
ggcacgagattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagaaaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaagggggcatggtgttccacatgggaaatt

SEQ ID NO: 8273 - DNA, 514 bp, Homo sapiens
tcggcacgaggcaatgtggtgattaatatagtaaatgtctttatagtaatagtgagtaatcattaattctaaagatagaattattattacaataaacaaactttagtcacatattggcagtttttctatttcaaacacagcaccagagatcagagtctacttgaaacttacatttgtgttatttaacaatttttctgtatctttttcattggtgttttgttttgtttatcttttgtttttgtttctttggtttggtttgtttttgttttgttttttgagatacgatctctgtcacacaggctggagggcagtggcacagacatggcccattgcagtctcaaactcctgggcttaagtgactcttctgccacagaagatgaggaagaatacatttttcatagtgatggggtctcactatgttatctaggctggtctcaaactcctggcctcaagcaaccctccaccttggcctcccaaagtgctgggactatagacatgaatcaccacactcagc

SEQ ID NO: 8274 - DNA, 139 bp, Homo sapiens
ggtttttttaaaaaggttttatggccagggttggtggctcatgcctgtaaacccagcactttgcaatgccaagctgggcagatcgctagaggtcagctgttcgaaaccagcctggccagcatggtgaaacctctctcct

SEQ ID NO: 8275 - DNA, 316 bp, Homo sapiens
aggaaagcttcaaggggaagtttacaaaaattatagtgtccatgataacatagggctatgggaggttgaggctgcaatgaactctgatggtatcacttcactccagcctggttgacagattgtttattctatttaaaaaaacaaaaacaagtccgggcggggtggctcatgcctgtaatcccaccactttgggaggccgaggcgggtggatcacctgaggttgggagttcgagaccagcctgaccaacatagagaaaccccgtctctactaaaaatacaaaattagccgggtgtggtgacaggcgcctgtaatccc

SEQ ID NO: 8276 - DNA, 535 bp, Homo sapiens
tgtttactcagcacatttcatcctcagctaccaaaggtaagttattgttttaggtcgttttccagtttctatttagcctaagaactccacccaagttagaaaagaataaaaatgaggtaaaaataaagcagcattatgaaacttaaaaaagggaaaggtcacacactaatgcttttccatcctgggcactggggactggggtgaaggctggggggtccattttcattattatctttgcatttacaaacacagcctccgacgtttagtatttgctttgaatgaggaaccgagaaataatgtccaagatgagttcaaaaagaggtgaatctagtacttggtagctaaagtaataatccagttgggctatattactctgggtattaagaaacaatagctaataagaagtagtttcagccaggcgccagtggctcatgcctgtaatcccagcactttgggaggccgaggcgggcagatctcctgaggtcaggagtttgagaccagcctggccggcatggtgaaaccctgtctctactaa

SEQ ID NO: 8277 - DNA, 221 bp, Homo sapiens
gaggctgaggcaggagaattgcgtgaacccagcagacaaaggttgcagggagccaagatagcaccattgcactccagccctgagcgacagtgtgtgactccatctcaaaaaaacaaaacaaaacaaaaagaatacaaataaacagtagaaatcatctccataaaaatgattcatttacaaatcttgtgggtggagactcttttcagaataatccttttggg

SEQ ID NO: 8278 - DNA, 62 bp, Homo sapiens
gttgtttctactttctggagattatgaaactggtataattatttgtgtaaaagtctttatgt

SEQ ID NO: 8279 - DNA, 443 bp, Homo sapiens
aagtgatattgcttggcgttcttttcctaatacatcttggagttcacttcatatcaagtaatagactgtttcattattctttgttatagctttatattttttctggtggatatatcataggtgagaggcccactccccatgtatggacattaagctcctccccaatactttgcaatgatgtacaacgttaaaatgaatagtcttggggtttttttgttttatttatttttttctgagacagagtcttgctctgttgcccagactagagtatgcaacctcagctcactgcaaccttcacctccaggttcaagcaattctcctgcctcagcctcccaaggagctgggattgcaggtacctgccatcatgctcagctaacttttgtatttttagtagagacatggtttcaccatgttgaccaggctggtcttgaactcctgacctc

SEQ ID NO: 8280 - DNA, 564 bp, Homo sapiens
gcatctagaaaggaaggagggatgcaccctcatcccaggcagaggaaggaggaaaggacaggagggaattgtaagagggaaagaaccatagctatttctaagtgaccagagcaaaaggtgggcagtgacaatagcaacagagaagactgagagctagaaggacccagtgtccggttttgttttgttttttaaattaaaaaaaaaaagtttttgggggccaagtgcggtggctcacgactgtaatcccagcactttgggaggccaaggcaggcagatcacctgaggttaggagttcaagaacagcctggccaacatggtgaaaccccatctctactataaatacaaaaattggctgggtgcagtggctcacacttgtaattccagcactttgggaggccgaggcgggtggatcacctgaggtcaggagtttgagaccagcctgaccaacatggagaaaccccatctctactaaaaatacaaaattagcttgggcgtggtggcacatgcctgtaatcccagctacttgggaggctgaggcaggagaatcacttgaacccaggaagc

SEQ ID NO: 8281 - DNA, 88 bp, Homo sapiens
gtacagaaaagaaaccccagtacatctctgagttttttggggtttgtttgttttttgttaagttctgggatacatatgcagaatgtgc

SEQ ID NO: 8282 - DNA, 646 bp, Homo sapiens
tgacaactgagctgaaattaattaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccagagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctccttggctttaattatgctaatgttggaggagaatgaataaataaagtgaatctttgca

SEQ ID NO: 8283 - DNA, 654 bp, Homo sapiens
tgacaactgagctgaagcgaaggaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccacagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctccttggctttaattatgctaatgttggaggagaatgaataaataaagtgaatctttgcaaaaaaaaa

SEQ ID NO: 8284 - DNA, 601 bp, Homo sapiens
tggggcccaggaatctgcattttaaaaacaaatgtcccatggactacacttgatcttagccaaaaggccaagatgtgatcatatgtctcatgtaattctgattttgttgttccttgggtcatactttggcaaacaccaatctgtgggtttttaaagaaaattgtttttttcttacttaagagaactgttaaaagtgtatacggtaaaacaaaagtcagaaagtttaaaagagtagacagtaaaaagcatctctccccatggataaagatgatcatggcagcagttttggtaatagtgaaaaattaaaaacaaaatgtccggccgggcgtggtggctcacacctgtaatcccagcactttgggaggctgaggtgggcggatcatgaggtcaggagattgagaccatcctggctaacatggagaaaccccatctctactaaaaatacaaaaaaattagccgggcgtggtggcaggcacctgtagtcccagctactcaggaggctgaggcaggagaatggcgtgaacccgggaggcagagcttgcagtgagcagagatcgcgccactgcactccagcctgggcgacaaagcgagactccgtctc

SEQ ID NO: 8285 - DNA, 448 bp, Homo sapiens
gacagaaggatacggctgcgagaagacgacagaagggtcagcgactggtgtgcaattctctttcaccccgtcagggtgagggcacatgtcaacaactctggcagggtgaggggaccagctgcgacctggatcatctatagggtggtggctcagcctctctaagcctcagtttcctcatctgtcaaatgggcagcaacaactatgtcagagagttgatgggacaaatgaatcaaccgcccgggtgtggtggttcatgcctgtaatcccagcactgtggggggccgaggcgggtggatcatgagatcaggagttcgagaccagcctggttaacatagtgaaaccccatctctactaaaaaatacgaaaattagccgggcgtggtggcaggcgcctgtaatcccagctacttgggaggctgaggcaggagaattgcttgaacctggtaggc

SEQ ID NO: 8286 - DNA, 336 bp, Homo sapiens
aataatttcttggttaaatgtaaggtaagtagtcaacacttaaacgatgctacaggccaggcgcagcggttcacgcctgtaatcccagcactttgggaggccgaggcgggcggatcacgatgtcatgatatcgagaccatcctggctaacacggtgaaacccctgtctctactaaaaatacaaaaaattagccgggcgtggtggcaggcacctgtagtcccagctactcgggaggctgaggcaggagaatggcatgaacccgggaggcggagattgcagtgagccgagatcgcaccattgcactccagcctgggggacagagcgagagtccatctc

SEQ ID NO: 8287 - DNA, 370 bp, Homo sapiens
gatgagattatgaaagtggaaccctcgtaaatgggattagtgcccttctgaaagtgacggaagagagctcgccagcaccttccatgtggggagacagggaggatatgacagtctccaacctggaagagggtcctcaccaggccccgatcatgctggcactctcatcgtggacttccggcctccagaactctgatcaacaaatgtgtgttcttaaagaaaaaaaaagtgtggaaagcaatgttaatgttcccaatcactttgagtacattctttccttaactatgtcttaatgcatagttgtgttggatggcctagtttgtaatgttagaatatgcatgttagtgaattaataaatacagcagtaaagaat

SEQ ID NO: 8288 - DNA, 633 bp, Homo sapiens
ggatgacgtcgtggttgcggtgctctactatgcacaacaccgtggctacattaaaataaaagaagttttaagccctactccccgcacgaagcagaggaagggtgagcagggaggagatcctcctgtcgtgtccattctgagccttaagtatatttctgtttttcaaggcaaatagattctggtccacttttagaaaccttaatctcggtcttcgttgtgtctggtgaatacatgagtgaccagcaggtggtgccagagacagttggtagccagggaatgccctaactgtcctcggctgggatagctgaggtcactcactggctggagttgagcatctggggctcacatgcagacgtgatgggaaactggatccttttaatatgaaaaatgggtaactgtagagctaattcttattgtataaaaatagcactcatttttttcactttaatagatatttatcaggctgggtgtggtggctcatgcctgtaatcccagcactttgggaggctgaggcgggcagatcacctgaggtcaggagtttgagaccagcctttccaacatggcgaagccctgtctctactgaaaatacaaaagttaggtgggtgtggtggtgtgcacctgtaatcgcagcta

SEQ ID NO: 8289 - DNA, 119 bp, Homo sapiens
cacttgaggccagggttccagaacagccaggccaacatggtgaaaccccatctctactaaaaatacaaaagttagccagacgtggtggtgcaagtgcctggtgcaagtgcctataatcc

SEQ ID NO: 8290 - DNA, 235 bp, Homo sapiens
gatattaacaagttttgtctctatctcagaatgcatttcggaatgcccttcctggagcactacagacactgtctctcaaaacgctccttgaactagcttcaccgtgttgctgactcccttgtaaattaaagaaaatatcttatacgtattccttcattatttgtatgaaagtcaagcttttcatattgtgaaaattatacttcaggctgggtgcagtggctgatgcctataatcc

SEQ ID NO: 8291 - DNA, 477 bp, Homo sapiens
tctggctggcattatcttcctctaggtacgattccccttgctgtctggcaggcagctatggtagagcagatctctctaatcagggcctgagcttattaacggctgggtttccattgttggcaggcacagactagaatggatcatcccagtctaggtgtactactctccagaggcaccagtttagagcctggattgtttgttaggatctttccctgcacccaggaaactctaaattttttcacctcggtaccttgtaacttgaaaattctactctgttatccagctctttttctgtttgttttcttagcctctcatcctgcacagcttaagaatttggcaaatacgggctgggcgtggtggctcacgcctgtaatcccagcactttgggaggccgaggcggaaagatcatgatgtcaggagatcgagaccatcctggctaacacggtgaaaccccgtctctactaaaaacataaaaac

SEQ ID NO: 8292 - DNA, 67 bp, Homo sapiens
ggccttcaaggaaagttaaataattggtaaggccaggcatggtggctcacgccacacctgtaatccc

SEQ ID NO: 8293 - DNA, 555 bp, Homo sapiens
atgaagatgacgaggataaaaacctttacgatgatccagttccactggataaatagcaaatatatcttctcttatttatgattgatttgcttaataacattttatcttctctagcttactttattgtaagaatacagtgtatatacatgtaatatacaaaatatgtatgaattgtttgttttcagtcaacagccttgcatcttacagtattttaccctccccattctctggtaactactattctatattctcctttctacttgtatgagaagaaccttttagattccacatgtgagtgagatcattaagtattatttttaatttgaaagaatgacttagaaaaatacttgacctttacctacttaattcttgtttccacaattctatggtttcaaagataactgttaacttggctccttctaaatgcaccactgaataagcgctcattatgagtgactataatcctaacagaaagattgctcatttaaacccattgcaaaagtcagtagaagttaatagtttatatttggtcatagaaccttttatagtgactga

SEQ ID NO: 8294 - DNA, 589 bp, Homo sapiens
atcttaactaattacatctgcgagggtcctatttccaaataaggtcacctgaggttctgggttgatatggtttggctgtgtccccaccccaatctcatcttgaattgtactctcagaattcccacgtgttgtgggagggacccggtgggaggtaattgaatcctggaggcggtttcccccatactgttctcatggtagtgaattagtctcacaagatctgatggttttataaggggtttccccttttgcttggctctcattctctcttccctgccaccgtgtaagacgtgcctttcaccttacaccatgattgtgaggcctccccagccacgtggaactgtgaatccattaaacctctttttctttgtaaattacccagtctcaggtatgtctttatcagcagcatgaaaacagattaatacatggttagacatgacttttcgtgggatactattcagcccagtacaaggcatctttgtggactctgctacattctgcggggtttaaggttgcaattacggaataaaatagtggggagaactagttacaaagtgtggagaagacaggagatgggtcttcagaagtattt

SEQ ID NO: 8295 - DNA, 444 bp, Homo sapiens
aatttttgtgtttttagtagggatggggtttcgccatgttggccagcctgttcttgatctcctgacctcaggtgatccgcacaccttggcctccccaagtgctgggattacaggtgtgagccacggcacccagcctgggctatttctttctctcctctgggatgaggggtgggggattgctctccagggcattacaagataaatgatcagaaaaacctacaccagccattagtggtgatgtaacagacagggtttctaatacagagaaaccgtaaagcaagagtaacttactgatctgttctactaacttgagcatcactcctccaacatgaaggtctccagatactctcagtgtgacgtctttctgctgctcttcattgggatggtcaacgcggaccacaagctcccaggaagcaaatgtaaagtcagtggatgacagcattg

SEQ ID NO: 8296 - DNA, 636 bp, Homo sapiens
attctcatgcctcagcctcccaagcagctgagattacagacattcaccaccacaccgactaatttttgtatttttggtggagacagggtttcgccatgttggccagcctggtctcagactcctgacctcaagtgatctgcccgccttgatgtcccaaagtgctgtgattacaggcgtaagccaccacacccagcctaataaatgcttttttattgtgaaggtagtaagagacttatacccagatctcaatctggagtcttcagtgttcatttcagaaactgaaaagcaatgactatccatcaccactccccacttccatgactactgtacaatctcaacttcattgctcttggctctcctttccctcaattatatttattaataaaaataaccaggccgggtgcaatggctcacaacccgtaatgccagcactttgggaaactgaagcgagaggatcacttgagctcaggagtttgaaatcagccagggcaacatggcgaaacctcatctctacaaaaaaatacgaaaattagctgggcatggggcacacctgtagtcccagctacttggaaggctgaggtgggagggccgcttgagcctgggaggttgaggctgcagggagttgtgatctcacca

SEQ ID NO: 8297 - DNA, 547 bp, Homo sapiens
gtgaaaccccgtgtctactaaaatatatatatacacaaaaaattagctgggtgtggtggcgggagcctgtagtcccagctattcgggaggctgaggcaagagaacggtgtgaactcgggaggtggagcttgcagtgagtcgagatggcaccactgcactccagcctgggcaacagagcgagactctgtctcagaaaaaaaaagaatcctacaaaaagatattctcatggagagccctaagccaacataagtgactacagtagagtagcaatggccacagggcaggtccagccagagaaactatctaagagagacccaccatctccacctccatgtttccagaaacatcctagtagcacagaagggcatctgaatttttcccatggtttccccgacatccttccccatgagctccaacaatagtttggctgagagaaatccaatggactgggaatgtccttatggttgcatagaccggggcaagtttagactgtgaacatcagcggcagatggcagtgaggatagatacctaaaaccaaagccatctc

SEQ ID NO: 8298 - DNA, 641 bp, Homo sapiens
tggccaaggcaggtcgggggagtaggaggtagtggctaaggggtgcggatttctctatagagtaatgaaagtttctaaaagtgactgtggtgatcgatgtacagctctgggaatactctaaaacctactgaattgcagatttcaataaataaagtgaatggtatgtgaattatattttaataaagctattattttaaataataataatagggggctgggcacaggtagtcatgcctgcctgtaatcccagctctttgggaggctgaggcaggaggatcacttgaggtcagaagtttgagcccagtctgagcaacctagcaagatcccgtctctatgataaaaaaaataaaaaaattagctgggcatggtggcacatgtctgtagtcccagctacccgggaggctgacatgggaggattgcttgagcccaggagtttgaagctacagtgacccatgatcatgtcactgtactgcagcctgggtaacagagcaagactctgtctctaaaaaggaaagaaaagaaatgcaagtttttaccactttgtgagtgtagccaagttggtggagaaatagacaagaataaaagggcactgaataatgaaggtgagtggctggttaggctcagttgctagcttatcagct

SEQ ID NO: 8299 - DNA, 542 bp, Homo sapiens
gaaatgtgtgcgcactgtcctgagttttcatctataagaacttgagtgtgtatggatcaattaactggaactcctcagaaaacagggtgaagttttgaaagaaagttcaagttacataaagcattgaatcacaaattactttgtgatttctcagaggatgtcagcggtaaaggcggtaaggctcacatgtcagatctccatggggaatttttatacctacaaattaaagccaaattgattaccctgtatagataataacgtagagttggagatgccacataaagagaaaaatcttcagcaagtgtgtaattattagaaaaccatatacttctagctcatgattcttttctgctttgtgttgggtagatgcagaaaagttataagcatcaacttaatgtggttgaggctttctgaactgatctccatttaaccagttcactgcattaactggtgttctcaactccttctatgacataagtcaactgatgctcatgctgggtgggttcgttgaccatggacatcccagttgcatgccacgcact

SEQ ID NO: 8300 - DNA, 536 bp, Homo sapiens
gctaacggtattaaaaattaaaaaaatgagagagtgagtaagctaggacactttgaatacttcataagttatacctatgctacttcaatttaaatccttcaggttaaaacaaaaaatgattggaccctttaacagaataggtgagatctgcccacactgtgtgcaggatttgggtcaggatttcctgaggccattcttcccacagcaagcacgttttggatgccccctatgttcagcccctcaggggtgctgattgtcctcttttctcctttccctgcctgcccctacccccatccatgccctcacttgtgaaatgtgagtgtgtaggtcttatactggcccagaatttaatttgatttgggaaacaatttaagtcattacatgctcaagattttcttcccccttcacacccacccaaaaagcatcattgactaaaattttaaactaataaccaacagggtattgataccaaaagcagctgttaaagaaatagcacttcaggccaggcacagtggctcacacctataatcccagca

SEQ ID NO: 8301 - DNA, 548 bp, Homo sapiens
gtgtaatcagtgaaaccgatcaaattttgcttagactgactgaccaagagaaaaagaaagaaaatgcaaatcactaaaatcagaaaagaaagtggtgacactgctactgactttacagaaataaaaaggaattataagagaagaccaaaacaaatggacatcaaattaggtaccctagatagaaggcaaattgctagaaacatacaattacaaaaagaaacttgagaagaaataataatcaaaaatctcctaataaagaaaagtctaggctgggtgcggtggctcacgcctgtaatcccagcactttgggaggccgaggtgggcggatcatgaggtcaggagatcaagaccatcctggctaacacagtgaaaccccgtctctactaaaaatacaaaaaattagccagtcatggtggcaggcgcctgtagtcccagctactcgggaggctgaggcaggagaatggcatgaacccgggacttggagcttgcattgagccaagaccgtgccactgcactccagcctgagcgacagagcgagactctgtccc

SEQ ID NO: 8302 - DNA, 114 bp, Homo sapiens
gattattgattcctccttttttgtatctttatgtaaagcattattctttctactttctagttacagatacacacacacacaaacacacacacacacacacacacacacacacac

SEQ ID NO: 8303 - DNA, 437 bp, Homo sapiens
tttgtactatattcacttcaaaaataaattcatagtctaagaccttgtaacaaagaaaactgcaggctcagatgacctccctggtgaattctactaaatatttatagaaaaaataataccaattgtacacaaactcttccagaaataaaagaggaaagaggtcagcattaccctgataccaaaagcagacaaaggcatgagaagaaaagaaagtgacagaccaatttgcctcatgaacgcacacacacaaaactgcaacaaaatattagcaaatcaaggccgggcacggtggctcatgcctgtaatcccagcactttaggaggctgaggcaggtgtattgcttgagcccaggagttccaagatcagcctgggcaacatggtgaaaccttgtttttacatatatgtgtatgtatatatattcacacatatatatcaca

SEQ ID NO: 8304 - DNA, 560 bp, Homo sapiens
tacccagccccatttaacttgtaaataagtattattataaactccacaatttggctctgaacttttttgtcaccaaggcaaaaaaagaaaaacctgataaattgtgaagtttttattgccaaaaaattttgttttaagtcatttttaattagatatttctgggtttctgttgaaagtactttctcaaattaagagaaagtataacatagtatactactgaaatttccagagcgaataaaatgataagtcagagattttccttttaatgtttttttacaatgtaggctttattaagcccaaaatataatgttccagtatttcaataattaaataacaaatgataaattaatatctattaaattacagtttatcgaagctattctattgttcgtgtgtggtggctcccggatcatttatggatacagaatgttgccaaccgatgctctggcttgagctaagaatagaggataatttgaatataaaattcaaacatggccaggtgcggtggctcacacctgtaatctcagcacttcagtaggccgaggtgggcggattatgtc

SEQ ID NO: 8305 - DNA, 402 bp, Homo sapiens
ttaagctactcagattatggtgctgtgttatggtaacctgctatggtttgaatgtgtctcctaaactttatttgttggaacctaaatccccaaattcatatgtttatggcatttggaggtgaggcattgagagaaaattaggatgagataaagtcatcaagttatgcctccattatgggactggtggctttataaagagaagaaaaaaagacctgagctgacatactgttgcccccctgacaggtaatcccctctatctttttatgatgcaataagaaggccctcgccagatgtggcccctcaagcgtggacttcccagcctccagaactggaagaaataaatttctttttaaaataaattactagtctgtggtattctgttaatagcaatagaaaatggat

SEQ ID NO: 8306 - DNA, 587 bp, Homo sapiens
tattaaacaatatccaattcaaaagttacatttgtttttgttactgtacgtttgtagagaaatatttgctggggttatcacgtgtttatccatttgtgatacatcaaaaaaccttcatataaaagaaatagtacatctgctcctaatttctcatgtttgtttcctctccttacatctttattttcataactgtatttggaatatttatgaataattccatcttttaagcctgacagcattaattttatcagaccagagagcctccccatgtatctctggcacattctagagtcaaggtgattagcccagcaggggtctgaagaagtactcataagacgctttttcagaaaccctcactgctggagtatcattttagtccctgcacaactgtaacccaaacttgcaaggcttgtacataacattttgtcatatatacagtaaatgtatataatgaattgaatttcttaaacagatattacaaagccgtagtagcaaatactttactaaaatgctaaacagcattcaactagataagtttatcccctttagaatagttaccatgacaggctgggcttggtggctcatgc

SEQ ID NO: 8307 - DNA, 457 bp, Homo sapiens
tgcccaggttttgagtgggtgtaagttttcagctcattggggtaaatgcctaggagtgcaattgctgggccatatggtagacctatggttagccttgtagaaactgccagtctgcttttgcattctcaccagcaatgaaggggagtcactgttccacatcgtctccagcactgagtgttgtcagtgtctcgggtgtgctgtgcttttaaactattttctttttaaagccgggcagattggaaagtatgcatcatttttgttgcccacaagaagcttgttttgaactgttttatgttcacagtttgggatttttcaggcaatattgctgagctttaacaggaactttgcagtcctgtcaacctgaatttgagcccttcatttgcaagtaaccttgccgtgtgactatgagcaaggtacctaacctctccattgttcagtttctttatctgtaaaatgc

SEQ ID NO: 8308 - DNA, 590 bp, Homo sapiens
ataatatgcctaggagagtatatgctaccttgggtgaatagtacatattgatagtaacatattgatcatgggtagctattttgcaagtgacaacaagggcttcagatttgttagatatttgacgtcaaaattcaaggttatcaggaagcattaggccaattatcagttcctaaagtgcgtctcagtaccaagaacatcaaaagccatgaggcagtttcagcagctactgcaaatggtctcctgggttctgtaagaataatttcattccagttagcacatttaacaggtaagttccaaatatacggttttccccaaatttgggggaagagaaaattgagaagaacttgctcattttcttcctgctcagtatatcatttggcttcctcttccagttcaccaggaataaatacaaaataaatatattggttaaatgtaagtcgagattaagaataaggggaatgtagaagcgatctttcctttactttaaaacttcaaatttaagcaagtgtcactttctaagaaacctctatcgtgtggtgacatcatttgaaagccctcttccttcataacaaattccttatgctctctct

SEQ ID NO: 8309 - DNA, 63 bp, Homo sapiens
ggtggggagtaagctggggctgcctttctgaaatgcaatttggtaacttgtaccaaaagcctt

SEQ ID NO: 8310 - DNA, 473 bp, Homo sapiens
tacttgttaagttttggtgttgtgtcaaagaatagccacaattatacaaaaaggctgtctcaaaaaataatgataattaataaaaaaaatattagttgggcattggtggtgcattacctgtagtcccaaatagttgagaggctgagttgggaggatcacctgagctcaggagtttgaggcttgcagtgagccaggattatgcattccatttgcattccagcttgggtgacagagtgaggggaaaaaaaagacaacatacgggaaaaatctgggagggaatattcaagtaagaagagaattcaagttagaaggattttttaataaaaatgaacagccagggctgggagtggtggctcatgcctgtaatcccagcacttttgggaggccaaggcaggtggatcatctgaggtcaggagatcgccaccagcctggtcaaacatggtgaaaccccatctctactaaaaatacaaaaa

SEQ ID NO: 8311 - DNA, 575 bp, Homo sapiens
gcaggagcattcatctctgtggccacatgtttggtccagtgtctgacaaataacattcaacttgtaggaacaagtgagagcagagcatcctttctcaggaacaaggcccatcccctggtgagctgctccactggagtcccaggtccctaacctgtggcctaggtagaccttaggatttgcctcactgatgccaatgagttgctgctgcttacttttgaaacaaagtgttggcatgttccagctgctgcgattcaattgcctttcagacagtgtggtgcccaacaaagcatccgtctcaacaccccgcggcctccccagctgccactagtagcaatccattacccacaggcagctcaacaactcaatgtgacttgggctccacgcctctacacaaaagatgcttccctgccctgttctcctccttcctgttgtgaaagcagcctcccttgcccttacccagctgtggctctctcagcggcttcctctagccccaaaggcctgctcagaataaggacctgcacacaagttgtgtggccctgggcaaaacctggagctgcttgatgttctgagcctgc

SEQ ID NO: 8312 - DNA, 539 bp, Homo sapiens
actccaaattcctgctccactacctgtcaataaaatggctttttgtgagcttggtccgggaataggattcttaaattaatatgttgtcacagtttaagaaaatgagcacagtgatcttaagacacagagatttattgtttctggcaaagtcaaacctaaagagaagaaacaacaaccactctttttttttgaaaacgtgttaggtgattttctttagctatacaactacacatcaaacaaggatttgagtgtgaggcaatgtgttagaacattgagtaagacacaatcccagttgctgcaggaaatttaaatagtgataaatgtgtaagaaaagtactgtggagactatggaagaagtgatttattttgcttcacagaggagggccttttgcaataagctatagaagtgtccaaaatggctctttcaagaaaaaatgacatctttcctcagttaccaccactccatcctaatgtaacagcattaacaatagcttttttggcaatatgagaaaagttggtaagatagagtaggaagtctt

SEQ ID NO: 8313 - DNA, 70 bp, Homo sapiens
tctatacaatcattggtcttttgtttctctatttttctaatcttttctatattagggatattaatccttt

SEQ ID NO: 8314 - DNA, 546 bp, Homo sapiens
agttcccatgtttagaatttgctttatagatgtactcgcaaaattatgtcaagattatgtaccagagttttttgcagcacaattttaaacaagaaaaacaaccttaattctgtcaatgaaataccatgccggccgcgcacagtggctcacgcctacaatctcagcactttgggaggccgaggcaaatggatcagctaaggtcaggaattcaagaccagccgggccaacatggtgaaaccctgtctctactaaaaatacacaaattagccaggcatggtggtgtgcacttgtaatcccaaatacttgggaggccgaggccagagaatcgcttgaacccaggaggcggaggtagcagtgagccgagatcacgccattgcactccagcatgggtgacaaaagcaaaactccatctcaaaaaaatatatacatatatcatgccaccatgacaaagaatgaagccgactggcatatggataatgtagaaagagctccagaataaaattgtatgtgaaaaagtaaggtgcaaacaatgtgacactattattt

SEQ ID NO: 8315 - DNA, 597 bp, Homo sapiens
ggcacgagggttgttctaggtagtttcatgcggatgctgacctaaactagaatgtagaaattagtaggaaagtgaatgcccactaggtggaaacctgaaagcacggggacctgcgatcttgtttactgttatattcctgctgcgcagctcagggtctctatgtaaaaaatgagtgaatttattttctagctggtgcctacaaaataatctgcaatgtatccatactggtttattaatggtaacaaatgaaccgtactaatatgagataataggggaaactagatatggagtgtatgggaattctatctttactatttctggaaacctaaaactactctaaaatagaaggtttatgttttgaaagcactctgctcattgcgctcttgtctgaaaagtgaagcctggcctcaagccactttgagtatttctcttctgccagttaattatcttaccattgcctctcagtgatattaagagaaaacccatccttaacatttttcattactttttaggttcaaaatgagcctgtttggaacaacctcaggttttggaaccagtgggaccagcatgtttggcagtgcaactacagacaatcac

SEQ ID NO: 8316 - DNA, 506 bp, Homo sapiens
ggcacgagctcagctcatgggaatctgtctctcactggtcctcactgggtttatcccagtgaccaattctaggatgaccagaacaatgattccactgggcttgggagtgtttgctggtacctctaatctctgtgtatagttcatggtacctgtgtgctctgtggctaggtcctcagagtcagtccctgggcacgtactgtcagccttcagttttccccacagactgtgttcctgggcctgaatcgctcagactacatgttccagcgcagcgcaaatggctccccagccctgaaacagatcgaaatcaacaccatctctgccagctttgggggcctggcctcccggaccccagctgtgcaccggtgggtcccctgggcagcccccggcatacctgtggggtgacatgctgatgggtgtacagtcactggctaagccagggaactccagctatgattgtgctttactgggccccgggtcacatgttgcccctggccaccccgacagca

SEQ ID NO: 8317 - DNA, 401 bp, Homo sapiens
  misc_feature 89, 158: n = A,T,C or G
taaactgtatatctgtaatatgaatcccagcttttgagtctgacaaaatcagagttaggatcttgtaaaggaaaaaaaaaacaaaacanaatggagatgagtacttgctgagaaagaatgagggaaggagttggcatttgttgaaagtatagtctttntctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaag

SEQ ID NO: 8318 - DNA, 378 bp, Homo sapiens
ggcacgagcttttttgtatttttacgctctgctgtccatgacatatttctaacacctttatgattattgttcctgcttgtaaaagggctgatatttacatgagtgcaaggcaggaagaaaaggtagctgtgccagccacttctggcaagcagttctcccaccttagcctcccaagtagctgagaccataggcatgagatttctcaaaattcctcccagcaggctttcacttagtttcattgttgagaactgtgacaggtccatctctagctgcaaaggaggctgagaaagtgaacacagcagtcctccttatccttggggaatacattccaagactggatccctgaaacagcagatagtactgaaccctatatatact

SEQ ID NO: 8319 - DNA, 550 bp, Homo sapiens
ggcacgaggggaaagaaaataactttgtgaagccagtgtattctgtttttaaaactgtgcctgcagtgcaatactccttctggtgtattttatccattatttcacttgctggtcgtcatttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggttcaataatttggggtggcttcatggtgtttcttttcttcccagtttaaaaaaaaaactttttaagcgtaaaatctttaaggggtacacatttataagtctggctaatttctaatatgctaattaaacatttcccattttaaggttatatacagtgaggctcttcaggacaattattttctgggttgattgggcatatgtttgccgtgtaaacacggatatgataaagtgtcagtaacaatgga

SEQ ID NO: 8320 - DNA, 398 bp, Homo sapiens
  misc_feature 296: n = A,T,C or G
ggcacgaggttgggcttagaagatggggctgagtagggagagagggtgctgcctgggagctgagccatacaagtgactgcacaggttgacatggaggattaggtggagtgaggcttccaagcagggaggggaatgatggtggggcccaaatgaggagccacatcgaagtagatgagagaatagaaggtgaagtaagggctggcgttgggtagggggagacgccagcagtgatgctgatgcccaggctgtaggtgtataggtgccatccacctggtaaagagagagctgtagcgcangaatgaggttgcacatgtagaagaagggaaggatacaggggagagaagtgtcttctagtcctaaaaaacagcctgtgggctggcatggtggaacaaacctgt

SEQ ID NO: 8321 - DNA, 644 bp, Homo sapiens
cccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttca

SEQ ID NO: 8322 - DNA, 383 bp, Homo sapiens
ggcacgaggcttagaaaattaacctttttctattaggctggtgcaaaagtaattgcggtttttttgccattaaaagtaatggcataaaccattacttctattaataaaaccctcaattttcattttcatagcctttcagaatgggagtaagctttgcaatcaacctgctccttcatcttatctgtacacttgataaatctgattcagtggttggaacggaatctgcttttcctgtattggttacaagcaagcactttgcctgggtgagtgtagctgcagtatagcatagaattaagactacagtttcatagtcagcgcagcttgaaatgttggctctatcatttactagctgtgtgatcttgcacaaaatccttaacttctct

SEQ ID NO: 8323 - DNA, 663 bp, Homo sapiens
gaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctctctaaataaggtaacttttttatacattttctttttatatgtatttattcttttttttttgtgacggggtctcactctgtcaccaaggctgaaatgcagtggtgcgatctcagctcactgcaacctccactttccaggctcaagtaattctccagctactcaggaggctgaggcaggagaatcgcttgaactcgggagatggaggttgcactccgtctggatcatgccactgcactccagcctgggtgacaaagcaagactgtcttaaagaaacaaaacaaaactacaaaccaatttgttttaaagcatgttttttctctgttaaagaaccttccagtgagtaacacaggacataaatttactat

SEQ ID NO: 8324 - DNA, 595 bp, Homo sapiens
ggcacgaggcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcaacctttgcctctaaactgcctggaaccaaatgtcgatttttctgacccctcccagggagtgctgagtagtgatggtgtctggagggtcaaatccattcccaatggcaaaggttcctcaccactccccaccgctacaactccaaaaccactcatcccagtgtttggggcactgtgttcctcttcgtccctgcaccagaccctggaagccttggccagagacctcaccagactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaat

SEQ ID NO: 8325 - DNA, 576 bp, Homo sapiens
ggcacgaggcaacacaaactgaatttccttattgctgatagctgcctgtagaggggtggtcaaagagactctacctggaaaactcttacagaaaaacattattgaataccctcttagtttcagagtttccagtctcatttctccttaaatctattcaccaaaacaccaccagtttcccctaccacaaacacacacataagtacacactcacctattttcaccttctcttccacttccacctttgtgttgaacctgattaaactctgatacttttaactccaaaatatgctatgctcttattaacaactggatcttagtagtttgcaaatgtttatttctcgtttatatgcagttcattgtgagcaggtggatgttctgctccatacccactgcagtccgagatctagacagaaaagtagcttttctctagaatattgtgggttccataccagacaggaaaaatgaaattacacagtggcttatataatttttgcttgtcactttcacccacatttcattgcaaaagcaagtcacatagccaaggttattgggtttaggaggggtctctgaaaatgg

SEQ ID NO: 8326 - DNA, 300 bp, Homo sapiens
gggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacat

SEQ ID NO: 8327 - DNA, 436 bp, Homo sapiens
ggcacgaggcacaagccactgtgcccggccaatactgcataatattttaaaaagttaaaattatctcttctggctggtcatagtggctcacacttttaatcccagcacactgggaagctcagtcagaaggattccttgaggccaggagttcaagatcagtctgggcaacacagaccccatatctccaaaaaaataaaaataaataaataaaacagttatcaggctgggagtggtggctcatgcctgtaatcccaccactttgggaggctgaggcaggcagatcatgaggtcaagagatcaagaccagcctggccaatgcggtgaaacttttgtctctactaaaaattcaaaaaataaaattagccaggtgagttggcgggcgcctgtaatcccagccgcttgggaggctgaggcaggagaattgcttgaatctggg

SEQ ID NO: 8328 - DNA, 661 bp, Homo sapiens
gaattcggcacgaggccttttgtggggtctcatacataactcagtttccacaaagctgtgccccagctcagccctatggatagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcaggatccaggaaagaaataattgataagctggacttcattaaaacgaaaacttctgctctgtgaaagatgctgccaaaaaatgaaaagacaagccacagactgggagaaaatatttttgatggaaatatctgagaagagaggcttgttatccaaaatatacaaagaatttctaaaactcaataatttgaaaataaacaacccaatttaaaaagtgggccaaagatcttaaatgacgcctcaccaaagaagatacacagatggcaaataagcatatgaaaagatgctcccggctgggcacggtggctcacgcccgtaat

SEQ ID NO: 8329 - DNA, 451 bp, Homo sapiens
ggcacgagcctgtgtccagcgtcctcggttcaggggaaatgttttggtgttcatgagtagtatgtcccccagtgccccattgtgtgggcgtcctcatggggtatccattcttctaggaagatcctggggctgtttccagttcgaagccattattaataaagctgcaaggaagaaatatttttatggatgtgtgtttttatatctctgataaatatattcaactggaatcattgggtgtattgggccattctcccattgccaaaaagaaatacctggccaggcgcagtggctcacacctgcaatctcagcacttgggtggctgatgcaggtggttcacctgaggtcatgagttcgagaccatcctgaccaacatggcaaaaccccatctctactaaaaatacaaaaattggctgggcgtggtgtcaggtgcctgtaatcccagctacttgga

SEQ ID NO: 8330 - DNA, 558 bp, Homo sapiens
ggcacgaggatgtcctgctatacaccatccactgccctgccccttaagcctcacatctttcatctctcctagttccaacccatggtctccagacgatgactctgcctccctgttctggtagcattcacagattgccttgtttagtagcctttcacatgagatccacttgacagcccctgtcctcacccctcctcaaactcctcaccacactgaaactcttccagctccatgagtaggttcttgggtggtttcttcacctgcaggttcaggtcaatgctcagccggggactcgacagggatgctttgcaggtctctggagtgctctttgtgcagtccctcctctgtggtactctgcccttgaactctcactgccttggcctccccaaagtctaaactttgtctcctcaactcagaaagtcctctgggctctgtctgggctccccttccctgtatgtggaattaaatctctctgcaggcaggaagttggggcaatcctagggctcactttgttatcttcccatctctcagggatcactgtcctgatgtctattgtcctgg

SEQ ID NO: 8331 - DNA, 108 bp, Homo sapiens
ggcacgagagcctgctgagggatgcccaagaagttccagggtgagaacaccaagtcggcagcggcccgggcacgtagggcagaggccaaggcggccgctgatgccaag

SEQ ID NO: 8332 - DNA, 370 bp, Homo sapiens
ggcacgagccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttcaagactccatctcaaaaaagggagatgatttacaaaattaagccagggggggccccacacctgaggcccagctattggaagcctaagcgggaagatggccctacctgggagggcaggctgcgggagccagaaggcccccctgcctccaaattggggacaaacaggaccttgctaaaaaaaaaggggtggttaattttcaaaa

SEQ ID NO: 8333 - DNA, 480 bp, Homo sapiens
ggcattcggagggaagctgacatccacgccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaact

SEQ ID NO: 8334 - DNA, 368 bp, Homo sapiens
gcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagttgtttgaggcagaactgaagcagaatgtaaacaaagtacaggagttgaa

SEQ ID NO: 8335 - DNA, 340 bp, Homo sapiens
ggctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaagggagaagg

SEQ ID NO: 8336 - DNA, 137 bp, Homo sapiens
tcgcgccattgcactccagcctgggagacaagagcaaaactccaactcaaaaaaaaaaaaaaaaaaacccgggaaaaaaatttttgggggtcaaaacttaaaaaaaaaaaaaaaatttttaccccaaaaaaaggggg

SEQ ID NO: 8337 - DNA, 357 bp, Homo sapiens
agcggggaggcttatcattttaggccatgaagttctgacatggtttgttatgcaggaatagacaactaatctacaccacatacaaattataatgttccttttttttttggttctattattgggttttataatatcacaatatgtcctggaattcttaattccacaattttaaaaaacaatatgataatacactttgaggaggtaccatagttcatttaaacaatcccttgtcaatgaacaattggattatttccaataatttggtcctggattttgaggatccaaatcccaatctacttgactgtcctggatttgccaggccttagggaatttcaaaaatgaaggtagggagggacc

SEQ ID NO: 8338 - DNA, 226 bp, Homo sapiens
ggcacgagcttgtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacgg

SEQ ID NO: 8339 - DNA, 320 bp, Homo sapiens
accaaaaagcatgacatatagaaaacaaataacaaaatgcagaagtcagtccttccttatctgtaattacattaaatgtaaatgaattaaaaggcagaaactggcagaacagatgaaagaaaaaacaagtccaactatgcacagtctacaagatactcactttggattcaaagatgcatataggttgaaaggagaaggatgaaaaaatatattccatgcaaaaaacaaggaacaaaagagtggctatactaatatcagacaaaatagactttaagacaaaattgttgggccaggcacagtggctcatgcctgtaatcctc

SEQ ID NO: 8340 - DNA, 655 bp, Homo sapiens
aaagtagttaatacagatgggatgcagccagacccgcctcatgcagtgatttcagcagatgcagatctgcctccaagctctcatgggcagaaagagccgcaagagaacagtgtccttgatgagcaattaactcatttacctaagtatctggtgcactaaatagattcacatcctgttctgtatgaatgaatggaaaacatcaaggatggcctttgtatgagtacaagtgtccaatgtgaaatctgtgtacaaagcacatgccattggaagcttggtcatcaggaaggcagaaaggaaattggctctttatagaatctttatagtacagaaacatatagaggtacatttccttcctctgagagtgccgttccataccacctggagagaatgccaggtggtaacaatgtacagcaggtttaatcaagacccagcatcctaaatcatgcgcagagtgccaggcgcgcaaggtggctcacgcctgtaatcctagcactttgggaggccgagacgggcggatcacctgaggtcagaagttcgagacatagcctggtcaacatggtgaaaccctgtctctactaaaaatacaaaaattagctgggatggtggtgcacgcctgtagtcccagctacccaggatgctgaggcaggagaatctc

SEQ ID NO: 8341 - DNA, 450 bp, Homo sapiens
gagagagtcaaattatataaagcaaaaatatcagaaagtaagtagaaatggataagcccccaaatattatagacatttcaaacacacatctttgagtaatagataaaagaaaaaattaaaagagtaagttttaaaagaagctagtggattttaaaaagggcaaatattatataaggaacatgaatattataattcatgttattttcatgttcatacagaatacttacaaaaattaacattttctagaccatgccacaaattcaaacaattttcacggaaataacgtgacacagaatatatttcctaaacaaacagcaatgaaggcagatatcaatacaaaaatgaaagctagaaacataagtctaataatattggttggaagctattttaatgaatattgaaatattttaaaggtgaatagtcaatacaaataaaccaaacacttttgta

SEQ ID NO: 8342 - DNA, 526 bp, Homo sapiens
taggactaaaaaggcattattccccgttcctcttatcaggaacctcattgacagaggcatttactttctatgaatacaaatgactatggctattgtgattagaagcagaagaaaaccagctcatgaaccagaccctgaacacaatatctgggggcatgacagatatcccagtcactcctggagcaggggagagagctgaagaggcatcacgttaagaagacgcaccagtgctgggcacatttggtgaatctaattaacaggggcaacttgtcggctgggcgccgtagctcacgcctgtaatcccagcactttgggaggccgaggcgggcggatcgcaaggtcaggagatcgagaccatcctggctaacatgatgaaaccccgtctctactaaaaatacaaaaaaattagccaggcatggtggcgggctcctgtagtctcagttactcgggaggctgaggcaggagaatcacttgaactagggaggcggaggttgcagtgagccgagatcacaccgctgcactccag

SEQ ID NO: 8343 - DNA, 641 bp, Homo sapiens
cccatcttgattatactttttcctgctgtctctttcttcaaattctggatcttatcttctatcatatccttcttatttacaaattactacataagtgcttgacttttaaaattaagaccacttaaattcaatgtgtatttttagtcagagtttactgtcattccatgtccacttaggttctctctctcctcattttctctgtttattaatatttagggccagtcaacagcacaaattaatgggaaattcctcctttggcattactcagccctttgttttaatttggttagtattaaattattttagtagcaaagttatcattcagtggggactaaagaatttaagtgctttaagttttatacttcctctagataaaaatatattgttctctttgggaggctgaggccggcaaatcatgaggtcaggagttggagatatcagcctgaccaccatggtgaaaccccgcctctactaaaaatacacaaatcagctgggcatggtggcagcctcctgtaatcccagctactcaggaggctgagtctggagaatcgcttgaacctggcaggctgaggttgcagtgagccaagatcgtgccactgcactccagccctggcaacaatgcgagactccttctaaaaaaa

SEQ ID NO: 8344 - DNA, 596 bp, Homo sapiens
ggcacgaggtcacctccactagagggggataaaaaggataataggaaatcagaatattttgatttgtagttcaactgttgatcaattatctttgagacttttaacattcatgactaaggaggattaataattaacatgagctgtagaattaaggtttgtatggcatgataagtataaaccagttttgggaccgctataattctaaaaaagcaggtagactagatgattagttgtacacttattactgctaattcttgattgtagaacaaattttcctatgaaaaccatgttgtgtattttatatctctattagttcgttaaaagtttagcagttttagatgtcgaaccagtaaaaaacaagttgcccattctatcattttttttattgtggtaaaatatatttaagataaaatttacgattttaaccatcttaagtgtacattggtacagtggcattggttacgttcacaatgttgtacaactgtcatccctatctatttccaaagctttttcatcacccaaacagctctatacccactaaacaacaactccacatcacccactccccagccctggttatctctgttctactttct

SEQ ID NO: 8345 - DNA, 369 bp, Homo sapiens
agcctggccaacatagtgaaaccccatctctactaaaaacacaaaattagccaggcttggtggtgcgcacctgtaatcccagctactggggaggctgaggcaagagaatcacttgaacctaggaggcagaggttgcagtgagcctagatcgtgccactgcactccagcctgggctggacagagcaagactccatctctgaaaaataaaataaaataaaataaaacaaaaaaacagaatagaagaagatagctaagaaccacagtggtcaagccagcctggcttcaacagagatgaatggagagaccacggtcagccccattaacagaagaactggggccaggaacggtggctcatgcctataatcccag

SEQ ID NO: 8346 - DNA, 300 bp, Homo sapiens
aattccgttgctgtcggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgct

SEQ ID NO: 8347 - DNA, 173 bp, Homo sapiens
agaaacagaaacttggtcttccagccccttatcagcctgggcacaagagcgacactctgtctcaaaacaaacaaacaaacatttaaaaagcgtctttggatttaaaccctcatctgttttctatttcatttattctttgttttgttttgagacagagtcttgctctgtcaccc

SEQ ID NO: 8348 - DNA, 339 bp, Homo sapiens
cccggagcaggagaagcaggtacaagcaaatgtgtgggcatggccttcatacccccaagcccagtcctgctcctagaaataaggagacaaagaccttcatgcctcagaccccctggcccatcccattgactccacagcctcagcttcagctactgagctctccacaaatgtggctcccactatgtgagactattttgcatgatacatagattattggatatctaaagacctattagaaaaatataactagcggccgggcgcggtggctcacgcctgtaatcccagcactttgggaggccgaggcgggcggatcacgaggtcaggagatcgagaccatcc

SEQ ID NO: 8349 - DNA, 339 bp, Homo sapiens
cgctgggagcccctcggcatcatgctctggccagcaaagcccctgcggcagcggcagcagctgtggctgccatcatcctggacaccatgttgccttgagaggcaattgttccttcccccattccatgggcactttcccagttatgacacaggatgatctggtcccagtgctgtaatggggagtggggatcacaggtggggcaatggaggagctctgaaagtggctttggatatctcactacccaaaaggaaaggcattagccaccatggccccaacaaaactaaaataaaaaggaaagggggtcaggcacggtggctcacgcctgtaatcccagcactt

SEQ ID NO: 8350 - DNA, 268 bp, Homo sapiens
gatcctggtaccccctgcccgcgccgatataatgctttttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattc

SEQ ID NO: 8351 - DNA, 479 bp, Homo sapiens
  misc_feature 433: n = A,T,C or G
aatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagaaacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtangaagctcttgatgatttgtggaatgaatttttaaaaaattactatc

SEQ ID NO: 8352 - DNA, 594 bp, Homo sapiens
ccgttgctgtcgcaatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatctttaaaccaaaattccagctatttaatttcagcatgaagaattgcattaaaaacagagcagtgaatcattttatgaataataatgctggattttatttttaaaaattatcctagcctaaaatgtttaggatcatcatagcattaagagagatttatatttggtaagaaatcaaaaacatcgtcagttttcatgcttaaagtatttaggatcataatagcattaagaaagatttatatttggtaaaaaatcaaaaacatggtcagttttctagtggaaatttttcatggcactataaatcttt

SEQ ID NO: 8353 - DNA, 261 bp, Homo sapiens
gagggttttcaggcagaggaacagttggccaaggaagtcagcttctcagagctcaagagatctgagtttaactcattaaagatggcatggaagaacagtgtcataatgcaaatgggaagatttcttctcttagtaattttatttctgccacgtgagatgacaagttctgttttaactgtgaatcgtaaaactgagaactatatcctggatactacacctggctcccaagcatctctgatatgtgctgttcaaaaccacacc

SEQ ID NO: 8354 - DNA, 444 bp, Homo sapiens
aaatatctaatatattttttctaattaagaacaaataaatgaaaaaaacaagtgaaacctttaatttgcatataaataagggaattaacaccagcatctaaggttatgtcaatctgtagaagattaattctttctcaccagaatttgtttccatgacatattcaagccatttatcaggcccagatattccactttccagtataagccttcaaagtacaaaaacatgaactgtaccaccccacttacgttgcatggatgttctcttgcttacttttattcaagtcccttcctaaacttgttgagcagtatttccacatacttactgatcataacaatcacgaaaaatagttgttatataatagagctttttatttcccgttattactagatgagcaaacatgccatcttgaattctaatcagtaacacacatgattcttattaca

SEQ ID NO: 8355 - DNA, 432 bp, Homo sapiens
aaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagag

SEQ ID NO: 8356 - DNA, 308 bp, Homo sapiens
agctgagtttaatataatcaatagaaatacatattaatgtaaaactttaactcaaaagataaaaaagcctctgctttaaaaggtttaggcaatttcggtaagtatttttattacagaattatagaatatctagaaaggcatgtgttgaataaagaatgagaacaagtagttgcttcaaactatatattatattcaaattatgtagtgcacggtattagtttctatacattcgttaaaatttaaaaaattctatttcttattttgtttaaataaaccaaaatattttatttcagaaaataatttaatct

SEQ ID NO: 8357 - DNA, 323 bp, Homo sapiens
  misc_feature 82, 281: n = A,T,C or G
caaaaacaaaaccaaaacactcttaatagaatagaaagaaaaaaacactcttaatagaatagaaagaccatccactgagtgngagaaaacatctgtgaattgttgtatacaaagttgtatacaaaatatataaagaaggccaggcacagtggctcacacctgtaatcccaggattttgagaggctgaggtggggggatcacctgaggtcaggagttcgagaccagtctggccaacatggggaaacctatctctactaaaatacaaaattaccaagcgtgcngggtgtcctggaatccagctactagagctgagcagagatcgt

SEQ ID NO: 8358 - DNA, 505 bp, Homo sapiens
gctgaaaggcctacacattaaaaactaacactgccttccctgaagggagatagtcctttcattttagctccttgcattgaaatagcattgaggattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaactaaaacacagctatatttcagatcatactgcttcatcacatcgagtgcatctacaaaggtaataaatagtatgtggctgagttagggcttgggaccattttctagaagatttgccctttctgcaattctagtctctataatgattggagtgtaggagttaagttgtggagcgtctcataaatttaactagaatcatcccctcttaaaatctaaatcaaatattgacatattagtcggccattatttgattacatttttattggt

SEQ ID NO: 8359 - DNA, 377 bp, Homo sapiens
agagaggagagattggtgggcagtttttgtgactcggacacattaaaacacatacatactctcaaatgaagttgcattcaggcaaatgcaaagaaatacagaattcatatttataaaaaccaaaagaaaaaagggaaaacaatgccttgtgtgagaataataaacatcaaattctattattattatttttttaagatggggtctccccctgttgcacaggctgcagtgtagtgacacgaacatggttcatggtctttgatctcctgtgctcagtgatcctcccacctcagcctcccaagtagccgggactatgggtatacaccaccacacccagctaatttttaaattttttgttgagataaggtctcactatgttg

SEQ ID NO: 8360 - DNA, 377 bp, Homo sapiens
gcgtgagctactttttttttaaacagataatcaacagggccaaagcaattaagtcattttcccagtcacttggccaataagcagcaagtcaatgaccagaacaaattatacaactttcatcttcccataactgatctaagcctaccaaaaaaacggatgagactagacagaagaaacagtgtcaccttcatccccggtcatctagtcaagaactacgcaaaagccatatgtaacagaaatctaggaccacaggctacagtgccatggcacaaacatggctcaatgcagcctcaacagcttgggctcaagcaattctcccacctcagcctccagagtagctggggctacaggcatatgcgccactgtgcctggctaat

SEQ ID NO: 8361 - DNA, 497 bp, Homo sapiens
tatatagccatctgtaaagtttacttcacatagtaaatgagttaacgatatttaatttcccatatttcttaaccatatctttttctttcatattttaatgctctcaacagagcatctaaataaagcaacagagtgaacacagggactttcaggcatatactaatggtgttcctaaaatgattcaatttgatcttacgcttcagtatttcttttcaaggtaaattaagtttgtgctgttgaaaaaatgttaaattgttgtttgcatcttctaatgagtatagtagctgagagaagatagctatttgcattcagaggcatgtccaagtagggagttccttcttctaactcttatagttcaggaacataaccaagtaataaagtgagtaataaacaaatagtgaacagtggccaggcatggtggctcatgcctgtaatctcagcactttgggagtccaaggtgggcagattacttaagaccaggacttcgagactagcct

SEQ ID NO: 8362 - DNA, 580 bp, Homo sapiens
gattataggtgtgagccactgcacctctgcctcccgggtaacctctgcctcccgggttcaagcgattctcctgtctcagcttcccaagtagctaggactagaggcgtgtgccaccatgcccagctaatttttgtatttttagtagagacggggtttcaccatgttggccaggatggtctcgatctcctgacctcgtgatccgcccgccttggcctcccaaagtgctgggattataggcgtgagccacaaaagttaaaaattttcaataaatgtgctgagtcctcaaaaagaaaacagaaaagtaccaagctaaaagatgcaagatcaggatctgacctcactctacaattttctgtctgtataagctggataacttacttaactcctcagagcctcagttttctcatctagaaaatgataacagcattttaaaaaaaaaattttttttaatttttttaaaattttattttttgaaaaatagagatggggtcttgctgtgttgcccaggctggtcttgaactcctgggctcaaatgacctgcccacctcagcctcctaaagtgctaggattatgggcatga

SEQ ID NO: 8363 - DNA, 547 bp, Homo sapiens
caggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagca

SEQ ID NO: 8364 - DNA, 351 bp, Homo sapiens
cttccgggatgccacatcctcctggttttgttcccctgccctggttgacagcactttctcctgcccttggctagttcctcctcccctaacctgcaaggtgtcccagggtcttctctatctgtcctcactcatctccctccatggctttagaaaacatttctctgtggctgagaaatgtgtatatagggctccaacctccactgaactcctgaagtcccgacacacgtcactggctcctgctgtcatcccacctggacatctgaatggcttctgattcccctttccagtcccctcccccatgtttcaaatggcagtcaaccaggccgggtgcggtggctcacgcctgtaata

SEQ ID NO: 8365 - DNA, 620 bp, Homo sapiens
  misc_feature 463: n = A,T,C or G
gctacaaaataatcaaaacaaatcataataaaaacggaagaaaaaaatatttcagtgttccttagactcttacaatgtaattcaaactgagttgtaatttcaatacacttcttctgttaatgaatgtgcagataactggtttaattttccattcaataaatttttcttataaagatgaaggaaggccaggcgtggtggctcacacctgtaatcccagcactttgggaggccgaggcgggtggatcacgaggtcaagagttcgagaccagcctggccaatatggtgaaaccccgtctctactaaaaatacaaaaattagcttggcgtggtggcgtgcgcctgtagtcccagctacttgggaggctgaggcaggagaatcacttgaaaccaggagggggaggttgcagtgagccgagattgagccattgcattccagcatgggcaacagagagattccatctcanaaaaaaagatgaaggaagaggattaaatatagtgcagattaaacaacatgaacaacttgtcccctgaagtatgttaatatgtaattagattttattatttaggcaaggattcccctaatggagcacatttctgaaatgatgaaaagtattaggatat

SEQ ID NO: 8366 - DNA, 302 bp, Homo sapiens
gagatctcagctctctgcagcctccacctcccaggtgcaagtgattctactgcctcagcctttggagtcactaggattacaggcgcccgccaccacacctggctaatttttgtatttttagtagagatggggtttcaccatgttggccaggctggtctcgaactcctgacctgaggtgatccgcccacctcggccacccaaagtgctgggattacaggcatgagccaccgtgcccggcctaggagaaatgagaactttttaaagaaaatggttccatcggctgggcgcagtggctcacgcct

SEQ ID NO: 8367 - DNA, 291 bp, Homo sapiens
agacagccataaaaacacaatagttcacaaaggtaaaaatatgtggaaagtatttccctctccccttctagatatggtcaaatgggaggtcatagaaatcccttttgccttttcagtttttaattttgttttgttttgtttttgagatggagtttcactcttgttacccaggctggagtgcaatggcgcaacctcggctcaccgcaacctccgtctcccgggttcaagtgattctcctgcctcagcctcctgagtagttgggattacaggcacccaccaacacgcccagct

SEQ ID NO: 8368 - DNA, 546 bp, Homo sapiens
gggttccactgtggtttcccaaggagaggtaaataataacagctagtatttattgagcacatactatgtgccaggctcggtgttactcatttaacactgtgttttctattaactaatttaattctaacaattccatgatgtagcttttattttcagatgaagtcaccaagacttgctcatggagacacagctggaaagcagaagcaccaggattcaagcctgggccggtgggaagcctgaggctcttacccgccctcccttcagtgctgccttccttcatgcttcacttgttcctttttcaatgtccctgcttttcctgccctcatttcaactgctcatccgtcttcccagacttttctacagacgtgcggcattgcagtactgctcttgctgcaaatgtcagatttccttggtcagatttgcttattgtgggactttctgctgagatatatcagagatgttacaactgcgagaaatgcaggcagttctctgcgatccatctgccatgcaatgacaagagatgcttaaaggctgtctggtagaact

SEQ ID NO: 8369 - DNA, 337 bp, Homo sapiens
ctcactcttgtcacccaggctggggtgcaatggcgtgatcttggctcactgcacgctccgcctcccgggttcaatgattcccctgcctcagcctcccgagtagctgggattacaggtgcctgccaccatgcccagctaatttttgtatttttagtagagacaggtttttgccatgttggccaggctggtctcgaactcctgacctcaggtgatctgcccgcctcggcctcccaaactgctgggattacaggcgtgagccaccatgcctggccagcttatcaaaactttaaggagtactgaaaatcatttagaagttagtaagttatagtctttatac

SEQ ID NO: 8370 - DNA, 197 bp, Homo sapiens
gctaaacctagccccaaacccactccaccttactaccagacaaccttagccaaaccatttacccaaataaagtataggcgatagaaattgaaacctggcgcaatagatatagtaccaaaaaaaaaaaaaaaaaaaaaaaaaaaggggggggggtttttccggaaaccccaacaggaaaaaaacccgggggggggggg

SEQ ID NO: 8371 - DNA, 473 bp, Homo sapiens
ctcttctaaaactgcctggaactgaattctgccaacaacctgaatgaacaagaaaatagattctcccttagcgacaccaggaagaaatgcagccctgatgacacctagagtttagcatagtgcaaccaatgtcagactttcaacctacagagctgaaagatacatttgtgctgttttcagtctctaagtttgtggcagcaatagaaaatgaatacactcttcttacaaattttgtctgcatatttttattggagtggggttattttaaaacaagaaaggacttgtgagtttaaactaaagattcttagaacattctggaatgatatttatttttatgaaataatttctagtttaaacacatgacattgattttagcttgcattctaagtcatctgagatttgaaggatgttccatgtcttagtcttatttattggggcaactttgcaattccaaaaattatatacacaaaatg

SEQ ID NO: 8372 - DNA, 568 bp, Homo sapiens
gctgaacttgatttaacatggttttattttgtttttaacaaatagaggccatgatgactgtttaggctgagtaatggaggcctctgctccaagggcaggctgcttttcaaacagttgccatctcagtaatttttatccatttgcatctcacaacatcacaagacaggtttacataaaagtccaggttaccctgcaggctgcgtggtaacctttgattttaggttgatactggagagaaggtccgagaagaagccatccttaacaggaaatacattaaaaaaattctttgaaactggttcctgtgtcattgaaaggcttgggtaagaacacacacatggctgggcatggtggcccatgcctgtaatcccagcactttgggaggccgaggtcagcagatcacctgaggtcaggagttcgagatcagcctgaccaacatggcaaaaccccgtctctactaaaaattcaaaaattagcccacacctggtggtgggcacctataatcccagctactcgggaggctgaggcaggagaatcactggaacctgggaggtggaggctgcagtgagcc

SEQ ID NO: 8373 - DNA, 333 bp, Homo sapiens
tcaagcaattctcctgcctcagcctccagagtagctgagattacagacatgcgccaccacacccggctaatttttttttttttttttaaggggagacggggcttttccttgtggggcagcctggccttgaactcctgaccacggtggggaagaaagctgaagccgacaagaatgataatgccttagaagaccttcagctgctgatgtttgaagccagccttactatctgtgggaataaccttgatgatcccccaacccactggaaccgcctttattgaaaggtcaaacagaggctctgtattggcgaagaggcaatggcacctgaaggaaccc

SEQ ID NO: 8374 - DNA, 447 bp, Homo sapiens
aagatagactctcactctgttacccaggctggagtgcactggtgtgatcatggctcactgcagcctccaactcctggtttcaagcgatcctcctacttcagcctcctgggtagctgagactactggggcatactaccatgtccggctaattattaaatttttttcttttgtagcgggggcagtctcactatattgacccggctgattgattttgaactcctgggctcaatcgatcttcccaccttagactcccaaattgttggaattacaggtgtgagccaccacacccagccacaaaggcctttttctgccttctcagctatctccatctgctggcccaactttggtattaaaaaattctgttggcccggtgtggtggctcaagcctgtaatcccagcactttgggaggctgaggtgggcggatcacctgaggtcagaagtttaag

SEQ ID NO: 8375 - DNA, 477 bp, Homo sapiens
tttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaac

SEQ ID NO: 8376 - DNA, 528 bp, Homo sapiens
ggcacgagccaccatgcccagccaagccatgaaatcttaatggctcaactaaacaaacatttatttctcattcacactacatgtccatggtgaggaagaccactctgctccatattgtcactcagagatctagacagatggagtctttactatcttatgatgttgctgtctcaacacacagcttctaaagttcctgtggtgggataaggtgtaaaaaacttaaactttctcttaaatgctttggccctggctagcatcagtcctatgaatcttcctcagtgctagggagttgggatgtgcagtcctccctgatgcccaaacagaacaggcaaaccagatattactgagtgcaagaaatccctactatgtgtactgaggaacaggattcaagctgtattagactcaccttctggttggaagctagaagacagtggaataatgctttcaaaattctgatgcaaaagtatttcctgtagatttgtgtatctagtcaaagcatcaatcacatgtgaaggtagaatgctaaca

SEQ ID NO: 8377 - DNA, 250 bp, Homo sapiens
cccatccgggtggtgcacgtgctgggcatggtgggcacatccctgctggcctctctgtggcaccatgtggccccagtggcaggacagttgcattctgtggccttcttatcactggcctttgtgctggcactggcatgctgtgcctcgaatgtcactttcctgcccttcttgagccacctgccacctcgcttcttacggtcattcttcctgggtcaaggcctgagtgcccctgctgccctgcgtgctggcc

SEQ ID NO: 8378 - DNA, 63 bp, Homo sapiens
ccctttaagggatattttgtctgtgatgattttctttctttttttttttttttttaaaaaaaa

SEQ ID NO: 8379 - DNA, 469 bp, Homo sapiens
ggcacgaggttacctggggggcctttgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttc

SEQ ID NO: 8380 - DNA, 385 bp, Homo sapiens
ggcacgagaaaggtaccattccaggggttctggggaaaagaattttaaaatgccatcctctaatacagacgtttataaaacttaaatgaaatgattgggcttaaccatatgcaagaaagtctgcagaaaataaatcacctagaaactataaatagaaatgtgctgctgaggctgggcacggtggctcacacctgtaatcccagcacttggggggctaagggaggcgtatcacctgaggtcaggagtttgagacaagcctggtcaacatggtgaaacgccgtctctactaaaaatacaaaaaaaattagccaggtacattggcacatgcctttaatcccagctaatcaggaggctgaggcacgaaaattgctcgaacccaggcggc

SEQ ID NO: 8381 - DNA, 606 bp, Homo sapiens
ggcacgagctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactc

SEQ ID NO: 8382 - DNA, 396 bp, Homo sapiens
ggcacgaggtttcaaactcctgggctcaagcagtcctcctgcctcagcctcccaaattgctggggttacaggcttgagccactgtacccagcccatcaataatttttgcctgaaacaatttttattgcgatctttgtgttgagagtcctccatggatctgttgtgtgcttacatgtcttgctgggtgtgccaagaatgcaaggcccaagaatgctctttatttgggccttttctcagggttgtttacacagctggtaatcttcaaaaacaagttaatgtttcctcttggacaaagagcaggcttgcccactgcttggtataaaaacaatagatttcagccgggcgtggtggctcatgtctataatcccagcactttgattttttttttttttaaaa

SEQ ID NO: 8383 - DNA, 472 bp, Homo sapiens
ccaacctatatatgtacttgacatatagtgttatgagtatttgtttacttatttattttaaggcttcctccaattactccagcatatatagcttttcttccaaatctacgaaccctgacatatcattagtaacatttatttgatacttaatccaacgcagggtacttttatacttacaaatttaagaattaagtgaggctgggtgcagtggtacacgcctgtaatcccagcattttgggaggccaagatgggaggatcatgatgtcaggagatcgagaccatcctggctaacacggtgaaaccccgtctctaccaaaaatacaaaaattagctgggcatggtggcacattcttatagccccagctacttgggaggctgaggcaggagaatcatttgaacccgggaagcagaggttgcagtgagccgagatcatgccactgcactccagcctgggctacagaggggaaaaaaa

SEQ ID NO: 8384 - DNA, 487 bp, Homo sapiens
gtgtgaggattcaggggtgaggtggatgcattctggggagaagaatggcatgagaagcaacaggaatgtgtgaaatgtgttcagggactagtggagagatacgcctgactggagaagaatgttctctaaaaaggaacaatgagagattatgttggaaaaggtggggccagttcatgaagggcagagtggggaaaggaaaggaaaccaaccattataaaggccctgcggtatacctgtgctttcccattcagtccttcagaaaagctcagaaggttgtacagcttaaagcttaagagcctggactctggaatcagagtgtctgggttcaaatcccagctctgccagtcattggctgtataataattttgggaaagttatttaaactctctgtgcctcagtctcttccatctgcaaaatgagggtagtaatgctaactacttaacaggattgatgtaaggattaaatgagttaatagctatgaagtact

SEQ ID NO: 8385 - DNA, 612 bp, Homo sapiens
gagctaccaaagaagcacctgacaatgagaaaatgctgatgagatgagaatttaagatataaacatctcctgggagtatttgcattataagaggagattatagaaggcccacctttcagaagatacacaaagaagtctgtggccactctccccagcaaaacagcaatttagtaacaatcataaaaacattttaagtctctgagaattgtcctaaggggataatgacaaatagagaaacagtcatccaagaaaatctaccaaatcttggcaagaaccatgagagtctgtggcatctggtccctgacctgttccatgaccaacccctactagctctgccttacaggagctttactctggggcagtgcagtcaggaaggctgggctctccatccccccaggtcccatcaagaaagtgaaaaagagcctacagaaagagagaaccaccgggcatggtggttcacacctgtaatcccagcactttgggaggcccaggcaggcagatcacctgatgtcaggagattgaaaccagtctggccaacatggtgtaacctcaactctactaaaaatacaaaattagctgggcatggtagcacatgcctgtaatctcagctac

SEQ ID NO: 8386 - DNA, 535 bp, Homo sapiens
accacagcagagttactgaaactgagaacagatttttgccaaagacagagcacagatgcagactggcccctacatctgtgggagaatgcagcagacaccacggcactatcaggcacagaaacgcattgcatccctacacgagcaggaaactgtcatgagctattataaaactaccaaaccataaaccattagaaccacaaatcagccaaggctggatgtggtggctcacgcctgtaatttcagtactttgggaggctgaggcaggtggatcacctgaggtcatgagtttgaaaccagcctggccaacatgatgaaactccgtctctactaaaaatacaaaattagctggatgtggtggcacacgcctgtagtcccagctactcgggaggctgagacaggagaatcgcttgaacccagggggtggaggttgcagtgagccgagatcgcaccattgcactccagcctgggcaagaaagagtgagactccaggccaggtgtggtggctcacgcctgtaatcccaccagcattttggga

SEQ ID NO: 8387 - DNA, 651 bp, Homo sapiens
gtcatcttttaggtcttgggaagaagcacttttccaaatcattctttaagcaaaggtattgaccacattttactctgggagggtattcctgctcatttgagaagcccacaaaatgcctcggcttcaacaacatatccacggttctttgtgttcctctcatctcatccttgcatgacactcggcaagcagggtgacagtaactaacccctatcattcaagttcaagattacagtcttgctgcctccccacatacctaccagacattgccttaatctttgggcaaagattttgatttgacaaaaagcaaataatctcaagagtattgtattttatcatttttcttaactttgaaagggatcttgtagataacaggagtaagaatttggagagggggccgggcaaggtggctcatgcctgtaatcccagcactttgggaggccaaggtgggcagatcacgaggtcaagagatcaagaccatcctggccaacgtgataaaaccctgtctctactaaaaatacaaaaattagctgggtgtggtggcgcacgcctgtagttccagctactcaggaggctgaggcaggagaatcacttgaacctgggaggtggaggttgcagtgagccgagatcatgccactgcattccagcctggag

SEQ ID NO: 8388 - DNA, 599 bp, Homo sapiens
gagagcagggatgaggccccacattgtcaagcccaagaacactggtattcagtcctaactcccatcaccactggtgctctccagactggcagacttagctagagatagtggctgctaaaagaggaaattactaagacagtggcattcaggggtccctgcaacttccgggcttggctcctgttgtattactctccaatgaagcctacctagacaatgaaggcatcagcacaaaatataaaaagaaacagtataatatcctaagggagatattatattactacaaccataaaataagaacagcatgttattaaaaataataaacaatgagctcagaaaagactcactgtaaattaagaatgatacacaggccaggcgtgatatggctgacatcagtaatcccagcactttgggaggctgaggtgggcggatcacttgaggttaggagttcaagaccagcctgggtaacatggtgaatccccatctctactaaaaatataaaaaaattagccaggcatgatgacgcatgcctgtaatcccagctactctggaggctgaagcaggagaatcacttgaacccaggaggtggaggctgcagtgag

SEQ ID NO: 8389 - DNA, 611 bp, Homo sapiens
atgttttatctcttacccattcatagagggtaaaagagagcaggccctaaacagagcctccttttaaactgatttttaaaaaactacctctgtggccgggcgcggtggctcacgcctgtaatcccagcactttgggaggccaaggtgggtggatcacctgaggtcaggagtttgagaccagcctggccaacatagcgaaaccccatttctactaaaaatacaaaaattagctgggtgtgatggtgtgcacttgtagtcccagctacttgggaggctgaggcaggagcttgaacctgggaggtggaggttgcagtgagccaagatcgtgccactgcactctagcctgagtgacagagtgagactccgcctcaaaacaacaataacgacaaaaaactacctctgtttctaacttctaattggctatagattataatgtctaatactgcattatcaacattttaaataccattttacactattagtatgaaaaacatagtaatcattaaaattgcatctgctagaatatttaatctgtcagaaaactgggtttaggaaacaatttaggcatgtaggctatcaaatatggcaaaaatgaaaagactatggagcat

SEQ ID NO: 8390 - DNA, 424 bp, Homo sapiens
tggctctgggagaggtgatggcttgtgacgggaaattgaattcaatttgcttcaccaaacttgtcctggagaggggggtgaagcagttcaaaagaaatacaatgaaactactggtgagcacattattgtcagaatttacagtagatacatgtgtcactcctgaaggtatccacagagacactgaacaataagagagacggggccatggcaggacagagcagcatgctccggacccatagggcgagatggaaagatgctctgggctctacatcactacatgatgctgcgtactctgggtcctagtcctcccatcagcaaattaagaatatgcaatcctccattcatcttatgaagatatcatgagcagatatttgatgcttattagcattttgagtttttaaagttcttaaaggaaatccatgtc

SEQ ID NO: 8391 - DNA, 597 bp, Homo sapiens
accaatatggtcaccaccacatttcctgatcactctgtgacagtggtcaaaatgttgagattagtgaaaaataattggaaacaatctgaaaggtgaaagtcttctttttcttttgagatagagtctcactctgtcacccaggctggaatgcagtgaaatgatcacagctcactgcagcctcaacctcctgggctcaagaggtcctcccgcctcagcctcccaagtagctgggaccacaggcacacattaccactcctagctaatttttaaattattttgtagagagggagtctcactatgttgctcaaacttgtctaaaactcctgggctcaagagatcctcccacctcaacctcacaaaatgttgggattacaggcatgagccactgtgcctggcccaaggtgaaagtcttttcatagaagaaaagataaacttgttgtatattcccatagttttaaaaatactcaggtatcaataagtatcaaatataatgttgattacacaaagccaagttacaaaaatatatgtgctagtatttttgtaaaacactgaaacacaaacaaagctaagtattctttatgaatttatatacacata

SEQ ID NO: 8392 - DNA, 589 bp, Homo sapiens
gcaattactcagtagttttattaacaacttgtaaatattcttttgattcttggaaacacctttatatgggagacaaaataaatatattgtttccagtaacaaaagtacatccccatggaatgacatattttacagagttcatcctatacctttttgttggtttgttttttgttaacagttgtttaatacatttagtgagccaggtattgtgtgagtcactgagaaacacaaaaaagaaatgagaatggatggcaagcctcagagctcagtgaagtggttttaaaattctatgaaaataactctgtgaggccaggtgtggtgacccatgcctgtaatcccagcatttttgggaggctgaggtgggtggatcacctgaggtcaggaattcgagaccagtcccaccaacatggtgaaaccccgtctctactaaaaataaaaaattagccgggtgtgatggtggacacctgtaatcccagctactcaggaggctgaggcaggagaatcacttgaaaatgggaggcggaggttgcagtgagctgagatcacaccattatactccagcctgggcaatggagcaagactccatctc

SEQ ID NO: 8393 - DNA, 583 bp, Homo sapiens
aaatatagaaagactatcaaatatcttgacaaaaatagagaggatgtttttcttatataaagctcatgaccaagtcttcagcaccaaatttgtatgtaaattctttgaattttttggaagaaaaatattgactagccttttatttgatttgatctttcagaacattacccactgagtaaatccatattccactctaagttttaataaaatctgtgacggagatgggtatttctgtcaatactcatttctggggatatgtgtgtgtgtgtgtgtgtgtgtgtgtgtgtgtgtgttgtatgtttcatgcctttatacaggttgagtatctcttgtgtgaaatgcttaagaccaaaagtgtttcagatttcagatttttaaaatatttttgaatatttgcactattcttactgtgtgaagatccctcatctaaaaatagaaaactcaaggtgccatggctcatgcctgtaatcccaatattttgagaggctgaggcaggtggatcacttgaggtcaggagttcaataccagcctggccaacatgatgaaaacttgtttctactaaaaatacaaacattatctggac

SEQ ID NO: 8394 - DNA, 482 bp, Homo sapiens
cagatttgaggtagactttctgactgatttcttttttagagagcggagcatgcatcttttcaaattcatattattgttgaattaattactaatagaatttatcctcagtgtgtttttccaaacaaatagatcacttgtaattggcattgctttgcaaatccaaaatcagacatccacgttcttaaaagcagtttatcctttttataagattctgtgttttcccctcaagatgactcagattttagattaaatgatagaatgcattctagatacatttctaagtaatcaagcccagacctggaaagtgtttacagggcttgctcttctaaatccttgtgaataatcagagaaactatttgaaaaatggtgttgtgtcagaaacaagttgggatccattcatttctgaaaaatcaaagaatttgcaaaatgagaacactggggccaggcgcggtggctcacgcctgtaatcccagcactttggg

SEQ ID NO: 8395 - DNA, 321 bp, Homo sapiens
ttttgtttagaaaggactcttacaacaattataaaaaaaacagaccatgcgcggtggctcacgcctgtaatcccatcactttgggaggccaaggagagtggatcatgatatcaggagttcttttttttcctggccaacatggtgaaaccccgtctctagtaaaaatacaaaaaaactacccatgcatggtgatgtgtgcctgtaatcccagctactcaggacgctgaggcaggataatcacttgaacctgggaggtggaggttgcaatgaaccatatcacgccatgcactccagcctgggcaacagagaaagactccgtct

SEQ ID NO: 8396 - DNA, 605 bp, Homo sapiens
tgtcattacccgagctagggcaaagcaacttcagactttacaaggccatggaggtgaggctaagacagccggtgcctggaatcagtactctctgccacctcatcttctgcaatctaataaacccaatctttctcttttttttgagacagggtctcgctctgtcacccaggctggagtgcagtggcatgatctcagctcagtgaaacatccacctctcgtgctccagcgattctcccacctcagcctcctgagtagctgggaccacaggtgtgtgccaccacacccggaataatttttgttttttttgtagagactggatctcaccatgtcgcccaggctggtctccgactcctgagctcaagtgatcctcctgccatggcctcccaaagtgctgggatcacaggcatgagccaccgtgcctggccaaaacccagcatttctaaggacttcattaacaaagaaataagaacaataccaactctagtaagcgacttctgtatttttatccacaaactaaataatgctaacagtaatttttaaacccatttttttccctgtgaacatacatagcttatgcttttccaataactaacatctctgaaaaa

SEQ ID NO: 8397 - DNA, 641 bp, Homo sapiens
tcctatccctggcttatgtaagagccaactagaccacagagcatataaaatcaagtgctgcttcacaaatgaaataaagtgttccttgattcattactaatgcgactatccacatacatggaaaaccacaactcagatattccccttttatttttctctagaaacatgaataaattgcttttggcacacttaattggtgtttgggacatacttttcacaattgaagtccttagtaaattactcaggagagagactctcctctttcagtacgttatttaatacttaggcttgttagtgtgtgtcatttacacataaatattttgttgtgtgaatgatgatgcctagatcctctcatctgaggcctggctaatagctagtatgcttcttgttaagactggttcagtcaaaaataagtgttaattatttttacgtgtgacaatggtattatgattatgtttttgaaaaaaaaatttcacaaagtgatctacagattgaatgcaatccctatcaaaataccaatgacattcttcacagaaatagaaaaacaatctcaaaacttgtatgaaaccacaaaaggttccaaataaccaaagcaattttgagtaaaaagaataaagctggaggtatcatactacctcact

SEQ ID NO: 8398 - DNA, 320 bp, Homo sapiens
gtacggctgcgagaagacgacagaagggggttaaacactgcagtgctgcattggcaaaacaggtattgcccaaattctggagcccagctccaaccctatgagtttgttgccacttaagacaaatcttctcagatgggaaaagaactttctgtggaggagcgatgccatcacctagggctagaaaaataaacaagaaagagtcagaaaccaagctttgcatactgaagctaaataaatagtaacacctggtcaaacctcaatctttacaagatccgaaatctcatgaccagcctacctgaaatacagggggaagagggaca

SEQ ID NO: 8399 - DNA, 356 bp, Homo sapiens
caccaggcctgcagcttgttctctgaggtgtcacccccttattcttttttttttgaaacaaagtctcactctgttgcccaggctggattgcatgggtgtgatctctgctcactgcaacctccgcttcccgggttcaagcaattctcctgcctcattctcccgattagctgggactacaggcttgccccaccacacccggttaattttgtatttttagtaaaaacagggttttaccatattacccaggctggtcttgaactcctgactttgtgatccgcctgcctcagcctcccaaagtgctgggattacaggcgtgagccaccacccccagcccatacaccccctcattcttgact

SEQ ID NO: 8400 - DNA, 435 bp, Homo sapiens
gaaactgggtgctgatgttttgagaagggaacccttgagtggtctcaggttttatttaaatttttaactgacaagtattgagctgctttcctggtatttggcacagacagttcatgtctctgagctttgtttttccgtgactctgtccctctcagagacatttgacaagcgttatcagcattttccgctttttatctaatggctttttgggtctgtctgcatgatgataacattcaaaagaatctacacatggtcaggtgtgatagttcatgcctgtaatcccagcactttggaaggccgaggcaggtggatcacttgaggtcaggagtttgagaccagcctggccaacatggcaaaacctcatctctactaaaaagacaaaaattagctaggtcagacgtggtggctcatgtctgtaatcccagcactttggga

SEQ ID NO: 8401 - DNA, 452 bp, Homo sapiens
tctagtggaaaaatgagataacgacaagaatggatgaatagttaataaaagcggagggatggaagctcaaagaaaggctcaaaggaagtgatagaagcaaaaaaaaaaacccactgtacataaatgaaaaatgtctttggtttccagcttcatcattctcagcaaactatcacaaggacaaaaaaaccaaacaccgcatgttctcactcataggggggaattaaacaatgaaaacacatggacacaggaaggggaacatcatacaccggggcctgttgtggggtggaaggaggggggagggatagcattaggaaatatacctattgttaaatgaaaagttaatgggtgcagcacaccaacatggcacatgtatacatatgtaaccgacctgcacgttgtgcacatgtaccctaaaacttaaagtataataaaaaaagtctttgatgggctca

SEQ ID NO: 8402 - DNA, 527 bp, Homo sapiens
tttcttctatcaaggaattgccttagcctaaaggcaaagcaattagctgtatgccaaagcccgggcaatccaggccacatctcccatatctagcctcatgtcccactttctttctgacttctaattctctttccatttcatcaggactgggatccctgttctaaagaaggtaagatataagttaaggcaaacacatctacggagatctggccatatatggtacaaagtggctaattgggacttgtgtctccaattccaacatacctctaaatctctagaaagagagagaaaagaggccgagcgtggtggctcacacctgtaatcccagcactttgggaggccaaggcgggcagatcacgaggtcaggagatcgaggccatcctggctaacacggtgaaaccccgtctctactaaaaatacaaaaaattagccaggcgaggtggcggccacctgtagtcccagctactcaggaggctgaggcaggagaatggcgtgaacctgggaggtggagcttgcagtgagccgag

SEQ ID NO: 8403 - DNA, 549 bp, Homo sapiens
tgacaggaattgataagggcacattatgtaaaatctggagggcaagcctttcccttttaggtcaacactcacccgcaagctaaaaaggctaatcaacagaagcattttctgtgttcattccagagaatttcccaggggcacaataaatctagcctgcctgtttacaggaacattgttatttaacaagctagtttccaagcttaagagttttcggtttcatcaaatctaacccagcttgctaaatgcctgacattcattattgtctgctccggttcctctgtgtattataagataattttgcatacttaatataaagatagtttttacccacaggactaaccttaaatttattagaaaactattctaaactcttggatccctttctcttttttttcttaaccatttacctatgattccatcctgtctttaacctgcccactagtacttctagctagctagtttatctgatttacacattcagtaatttatttgttcatccatctaatgttattttgagcctctgctctgggctatataaatgtgatatta

SEQ ID NO: 8404 - DNA, 571 bp, Homo sapiens
gtatccatgtaataggatgttttctgtcaccttgaatggtttttgccctaatactttttcttaaattaatagagtccaacctttaattttacttattttctttttacatattttcccattcttatgccttaaaacatctttgccaatttgttttagatatgttttagggagtagcaaataatttgtattttttattattaatcatttcaatgcatcctaattttctttccattttaatagaagtaaaatactgatataagttgttatcattgatatgattcatattatttatttgttttttcatcattttattttgcttacctgctgtgttttacatttcttgtaatatgattgttttgtttgagttttttggggggttattggtttcctatttgttttccgtataaataagtgatttatacactagctacatagaaataggacattctcttttagtttcataagctttgtttattattatttatcctagttactttcccatacatttactgttgacttttccatgccctgagatacattgtaaagaattatagtgtatatatttaaccta

SEQ ID NO: 8405 - DNA, 550 bp, Homo sapiens
  misc_feature 491: n = A,T,C or G
gaatcttttcggattctcttccatgctgtggcaggtgagcctcatccaatttgtgaaagcctgaatagaacaaaagtctgaccctccgctgagtaagagagaattcttcctgcctgaatgccttcacactgagatatgggtttttgtcctgttttcagagtagaaccaaaacattggctcttcctggaccttcaacctaccagcttttgaactgaacctacaccattggctctcctggttctcatgccttcaaattcagactggtgagtagcccccatcttaaggtcatctcggggcccctccctgaatcacttcactagcacaaactcagatgtgctcaaaaagggctcattataaataggcaaagatactcctatcattaggagattctaagggtttttggagccctgtctcaggaaccagggcaaagactcaatatatgtcttatataccacagggaatattaacaaaactaaaatctagttcttaanaaaacgttaagtcggccggcaacagtggctcattgcctgtaatcccagaactttgggag

SEQ ID NO: 8406 - DNA, 635 bp, Homo sapiens
cacagttccgtgtggctggggaggcctcataatcatggcaggaggcaaggaggagcaagtcacatcttacatggatgacagcaggcaaagaaagagcttgtgcggggaaactccccttataaaatcatcagatttcgtgagacttattcactatcatgagaacaacatgggaaagacctgcccccatgattcaattacctcccaccaggtccttcctgcaacaagtgggaatttaagatgagatccgggtggggacacagccaaactgcatcaccatttcacccacgttttatgtgttggtgctagtgggagtactaaaaaactgttcccagatcaataaactgggaaacaaaagtgagaagtggtagaaagctgtgaagaaggcccagaacagcccaccctgatatgccaggctgttcttttggaagaaagcagtttgtacacaagagaggtgatgctgagaaagtgaaaaacctgaaggttttaagagccgaaaaagtgctaatgtgaaaacacgccacatggttttatgtaggggcccctttactttaatgctttttccaacaggaaaatttgacttaagttatttgagtgcagaattacacaagaacttcaagaaaagttataaaatgtaa

SEQ ID NO: 8407 - DNA, 653 bp, Homo sapiens
cactaaagctcccagctctacctcatcccaatttcctcaaaatgctccaagtaaagctatgcctttggaaaacaccccatgaattcactgattcagttttatgcagctatccaaacactgagcttaattttgtttactttaagaagagggaaaatagcctccaaaggtagtaaatcaagtagaattatttcagttatcaagtccttctctgtgaaactcaaagtcagcagttgaaatgatcaacctcttaaaaataattaaaagcagacatctggaaaatactagtaactgcagcactcacagcgccagaaacatattccaggaataaccaaggcttcattttttcaaaaaaattatatttttattttattttaaacagaagcttatcacccatgaacataaaacacgaatgtctaataaaatttacttttaaaaaatttcagcaagttaatgtcaacacatgttattaatttttgctaggaagccattcttaatggggagtctagaagcatggccaaccagagtttaatgagctggtggctgttcaatagcacatgcatcacaatgagaccagatggaccattaaatttcatcctccacattcttttttggaatgtgaaaatattgtcccctatatctctggcacacctcta

SEQ ID NO: 8408 - DNA, 363 bp, Homo sapiens
  misc_feature 265, 266: n = A,T,C or G
gtttctaaaattaaaagatgtaagtggtattttaatataaagagctatttcaaatatttaactttgtagatggaaaaggaagtgtattaatttaaagattcactgctgtttaaaatattccccttattttctttcaataaaaactaaaaagtagaggggaaagaaaggcactaagagagcaacgtagacagtgaaaatgagtcactagggaataaagaggtaaggatgccttatcttctttggctcatgaattacccttacctannatggtaaaggagatttgattatatgaatattgaattattacatatgccctgaaattatgtacatctaatatgtatcaataaaaataaataaatggga

SEQ ID NO: 8409 - DNA, 563 bp, Homo sapiens
ccatctgtgtgacctcgttccggccatgaaacccctctgagcctcagatttctcatttgttgtgtggaaatggtgataatgtctgttctacctgccccataaggttgctgtgaagatgatgtaatataatgtatgtgaaagatttaatttaataatactaaatagagcattataatattttctgatattaatccattaagataactatttactagctgtctatttggctaactgataataatccttttgagctagtataggcaataatatgcatggtacctaatctcctgttcttctcttgtcaagcctgatccaaatttttgatgtatcttggcagaactgagccagtcttccaaagaactaaaataataataatgaaaagaacatatttagcaataatatttttgagataacatttttcttctttggctgtacttgctaaaacaacttacccaattttctggaactgtccttctaagtagttccaaacatatcttattttctgcactttgatgcatctcacctgcaaaagaaaagtactaagaaaacctctagtttgagga

SEQ ID NO: 8410 - DNA, 515 bp, Homo sapiens
ttccgaaaaatatagtttcactttctatattatccaaaactattccaattagtaacttgtactttaaaaaagacaactgttttataaaatacactaaagagatttaagagaatttaaaggtcaaagttacataattacattctgctcttcattcagtgctctgaatcataaaggcatattctcatctctttttttactcaccattctcaatctttaaaaaaaaagaacatttggctgggcatggtggctcatgcctgtaatcccagcattttgggaggccaaagagggtggattaccagaggtcaggagttcaagaccagcctggccaacatggtgaaacccagtctctactaaaaatacaaaaattagccaggcgtggtggtgggtgcctgtaatcccagctacttgggagggtgaggcaggagaattgcttgaacctggaaggtggaggttgcagtaagccaagatcgtgccactgcactccagcctgggtgacaagagtgagattccatctc

SEQ ID NO: 8411 - DNA, 547 bp, Homo sapiens
taacatcttcagatgcccagaaaaaggagcagagaatttacattgtagtgaagtgaggatagtggttttttctaacagtttattatataaattttcaaatatgcaaaaaagcagaataattttacagtgtacaaccatatgcccatcaccttgtttctacaatcaacggtgtacttgctttaccacgtatctttcaagatgatatttgaaattaatgttttattatgggcattgccaatgtatgtgaaaatagagggaataatataatgagccctcatatattcatcatctagtttcaacagttattaattatggctaatattatttcctataaccatctgtctcttgtcacattcttcactagattatttaaaagcaaatggaattttgttgagtggatttgttagaagcaaaggaatacagcataatcacaggccctggagcaagagttgtttcgtgatcaaacatggaaacccaagttggcagagaaggacatggggccaggaggggactgataagctagaataaaatggaaggatcaaggggc

SEQ ID NO: 8412 - DNA, 533 bp, Homo sapiens
ctcccctcattttaaaaatggagaggtaatcgtgcctctcatgagcgaatagttttagtatgcttagaacactgtcctgtacatagtaagcattcaacatatgttggctaatactactgaagccaattgtaacagtagtattagaagccgtaataatattaccccagtcaaatatgtccataattggcaatagggaaagaattgctgccactcagcagtatttggagtattgaatgtcattgtttactttttctggaaggagcgtgacctaagacactgatctaaactgaatgtgcatggctaatggtgtggatagacagagattttaagtgggcaaaagtgaaggttgttttgacaagaagtttcaggaaacagtgatgtggatgaatttcccagaacggtcccagaatatgagaataatgtcccacgtgaatgctaatcgaaattcccactcttcagaggaggctatcagcaatcaggtacacatcaaccatatggctgtcatgtagtctcttcgtatcaccccacttact

SEQ ID NO: 8413 - DNA, 610 bp, Homo sapiens
ctatattttcatcttttaattagtatttatttattattattattgtgacaagatctctctgttgcctaggctggagggcagtgccacaatctcagcttactgcaacctctacctcccactgatccctccacctcagtctccagaagagctgggactacaagcccacgccacttggcctggctaattgtgttttcagtagagatgggttttcaccatgttactcaggctgatggcaacgatcctgggctcacgcaatctccttgcttcggcttccccaaatttaccatgcagcaaagcggttgctctgttttcattaagattaatacaaactagaattaaatgcaaaatctcctattttgttatacaacttctttaaggaaatcacaggttccgtggtacagaaattgtttttaccatttaagctagagtactatggtgctgaaagaaagacatacgtctcaggcttatgtaatttcagcagaaattttctttaaacaaaatatttattttatcttctcatttctacacataaacagaatattcatgttgtagcttgcataactatgtattgttggaagtaaagcacaaaaacatttagggctcatggctt

SEQ ID NO: 8414 - DNA, 597 bp, Homo sapiens
gttacttttcaattcctaggaaattgaattctcttctacttattttcagatcccaactcaagtaacactttctcacagaagctatcccttactctccagaatagatcaggcacctgctctacacttccacagctccctgcatttttcctccactgcacataataatttgtagttatgtttagtagtgtgattatttgtttaatgtttgtctctgtcactacactgttagttccatgagggcaggaatcatttgtccaccatagtatccaatctggcacagtacagcaacaaaagaagtatttgctgaatgaataaaatgagtgtgtgtggctggttgggggtgggtgaatattaatgtgaacataactcctcaaagaaagtaaagaattgaaaaaggagaaggaaaagagaaaacattttattatgaatatttcaaaattgcaggaaacacactgcaaatccccggggagccacttcctatttcaatcaaacccttattcaacattcttggttcctttttgttttaattgagatataatacttagatctcaagtattccattgacgggcgcggtggctcacgcctgtaatcccagca

SEQ ID NO: 8415 - DNA, 555 bp, Homo sapiens
gttcggaggactcattgcgctgagcccataaagaatcctgagaagttctatccagagaaaccagttcattttgtccagtgtttcccaaacttatttcctcatggagccctcctccctttttccatggaatatctattaacctcctgcagggtgagattccaaggtgtgacttgggcaaacactatccgtaacttccatagattcactctcagtccccttcagggggggtttcagagcaattaaatgcctactgtgtgtgaggcccacagcaagtggctaggaatacatcaataaatcagacacaccccagcttgggaggaacctgcaggctgagcgacagccacaccttactgcttgagtctgacctgggcccaccaaggctgtataaccttgaccaagtcactcttctcctctagtcttcaattcctccaactgtaaaatgagagaatgcaatgccacaatccctaaagacctggccagccggagcaccaaatcccttaggctgccatgattggttccagagtgggtgcatgaaccaagctgagccaatgagcg

SEQ ID NO: 8416 - DNA, 573 bp, Homo sapiens
gagaaagaaaggaggagaataagcatctgacagccactgagccggggctgccaccaaaggggccttgaagagaggtagagggcatggacgctctgaatgcagatagaaaaaagaaacagacaagaaagagaaggtggtagaaaaggtgagaaaagcaaagtaagagaggtgattaagagggtccaacatcactaagttgagaaaaatgcaagtttccaggaagaggggcagccgacagtgtcagaatatgtgagggactgggaagctgtgaaatcatcatatttcagaacgtgaggtcagtaattctgagggtaaaaataaaagctgcaatggaatgcaagatgaggcacacaggcaagtgtagagggataaaaaaggactttgctaagaagaaacaaatgcagggcctcctggagatagtgagctacaaaagatgcaagaaaaagaaggtgtttgctaaaagaagacagtagggtaaagaggtttcttcccacaataaaaaaaactagcatccacagaaatggaaaagtggctgggcgcagtggctcacacctgtaatcccagcactttcgg

SEQ ID NO: 8417 - DNA, 604 bp, Homo sapiens
aagtatttaagatatgtaggctgggcgcagtgtcttatgcctataatcccagcactttgggaggccgaggtgggtagatcacttgaggtcaggagttcgagaccagcctggccaacatggtgaaaccttgtctctactaaaaatacaaaaattagctgggtgtagtggtgcatgattgtaatcccagctactgggtagcctgaggcaggagaatcgcttgaacctgggaggtggaggttgccgtgagccaagatctcgccactgcactccagcctgggtgacagagggagactctgtctcaaaaaaagaaaaacaaacacaaaaaaaggatttaagatacgtaaatcagagtagccctgagctaacatcgctttaaacaggttttatataaattcttccttgtaactaatacttgaaactttggaaaaagacttcttatctataaatttgaggaaagaatgaagtcatccttatttggttaaatgtagtttaatttggttaaatgtagtatattcttcattggaagaatggattttgtctcctttattcttactgatttaagccatttaggtctgaagtcatcactacatgatgaaatacttaa

SEQ ID NO: 8418 - DNA, 582 bp, Homo sapiens
gtatgagccactgcacctggtcccaatttaaagctttttaacaagagtttttcagaggggaagggatagcaaagagtctacctaacctgtctaagaatcaaaagctttattgcctgaagcaatttatagaaaaagtgtttccaagtctgggaagaaaaaaaataatgaaccttcagtcattctttcagccactgttgtagtagcaaattgtgtccaataaaacaaaatccctgccttcaaaaagagggtcacctaataaattatatgaaatattcagagttcagcaaggcctcaaaaaagtatgaaaccaattgtacaaaagaggtggaaagttaacaaaaaaaagacataacaactgactctcagaagacaatcagaagtgtaccaggtaaaggcaggagatggtgaagggattaatattccaggtaagtaaagaatgtacaaacgcaaagaaatatcaagcagcatagtctgaatagcaaatcaaaaaataacaacaggttcaacttctgatagtgatagagtaacttatatctggctaacatttctgcatataacaacaataaatcttacataaaatac

SEQ ID NO: 8419 - DNA, 211 bp, Homo sapiens
cacaggtcttttgactttcagtctagggctcgactcgcttgctccacaagctactcaataaacattattgagcacatactttggtctggatatggtgccaggtgctagggccaagatgaataagtcctcttgtattgttcatagattgcacacagtctaaagcctatttgttgttgttttttttttggagatggagtctggatcagtcacc

SEQ ID NO: 8420 - DNA, 369 bp, Homo sapiens
gattcaagtgatctcctgcctcagcctcccgagtagctgggactacaagcgtgtgccgccatgcccagctgattttttgtattttagtagagatggggtttcactgtgttagccaagatggtctcgatttcctgacctcgtgatccacccgacttggcttcccaaagtgctgggattaccaggtgtgagccactgcgcccagcctcttacaaaatctatgttgcccaagctagtctcaaactcttggactcaagcaatcctcccgcctcagcttcccaagtagctaggattataggaaagtgtcaccacacctggctgttaaaaaaactattaaaaactttaaaaaaggggctgggcacggtggctcat

SEQ ID NO: 8421 - DNA, 456 bp, Homo sapiens
cgaagtgctgtgattacaggcgtgagccacagagcctggcctaatactactcaatttttatcaaacactctggcgctagtagacaatctcctttagggaaagaactgctttcaggaaaatattttaataagttacctgtaataaaagtgagaggcctttaaggaaggaaaaaaagaagatttatgctgcctctttatgggaaaacaagagggatttgtcacttattttttcctactgatggggagtggggctaaggaggaaagagagacaagagccagtgagctggtctgagttggggactgcgggaagtcatggtgggtgagtgataatattttaagcacagggacactcagagtttaatctgaagttccattgctgtgatgtaatccactctcttccttcccacatgtcatcagtgattatgacaatataaacatcagcagaaatcttggggac

SEQ ID NO: 8422 - DNA, 66 bp, Homo sapiens
tgcctcttgtccttgtaacatggcacaggttacttcaactctgtaatgcctcagtttcctcatctg

SEQ ID NO: 8423 - DNA, 623 bp, Homo sapiens
agttgttcgaatctaaatgtaccatttaagtcatgggtgatccctagaaacccattttcactgggtgcttctcaagactatttgggaaaagaacaggacagtgactcaaaaccagagactgtattcccaagcgccccatgcctcctgtcaaacagaaatgaaaccaaactagccacagccaactgggggggctcttccctgcctcagtttccttgcctgttgaaggcacacacaaacatgtatgtggtgtggaacaaaatgaaataggaagctgtggtgaaaattaaaagagctatgcagatgtaaaatgcagccactgtgagtattcgaggtaaggaattatacctacaaaagacgctcacggccgggcacagtggatctcacctgtaatcccagcactttgggaggccgaggcaggtggatcaccagaggtcaagagttcaagaccagcctgaccaatatagtgaaaccccgtctctactaaaactacaaaaattagctgggcgtggtggtacgtgcctgtaataccagctactcgggaggctaagacaggagaatcacttgaacccaggaggtggaggttgcagtgagcagagatcatgccactatactccagcctgggt

SEQ ID NO: 8424 - DNA, 609 bp, Homo sapiens
cggttgcgacatagacgacagacagggatgctcggggctgccttggcctaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaagcctcggtgaagcagagctcgtgggattcctgctgctccaggtgtcctcagctcacctgtcccagactcaggacaggggagttcctgcatttcctgccagggcagaggcccagaggagcgaccccctgcttccactgcttgggcctgctttctcagatagactgactgc

SEQ ID NO: 8425 - DNA, 561 bp, Homo sapiens
ggatactaagtcttccctgtatggtggttttgaatatctaatgagatcaaatacgatatgataagggcctgtcaaaagccatgcccttacaatttataatgggatctttaaattgacaatttcttctcctcctgcttattagcatacgaaagagaagttatttattttgagtcagtacaatgtatcagacagacattataggtttaagaatcagacaaactggaagatgctttcaagcaagtttattatttcattcatctattcattaaaaaatattgaaaaccatctctgcctcttactagctgagtgagcttaggtaaattactaatgttcttcagctttagtttactcatctataaaattaaaataatagtacctaaatagtaaggtggttgtgaaaatggaataaaacacacagcctgcagcacattatcggtggtaggtatattatgctagatgattattttaataaatgaattagtgagtagccacttagcatgggttttttaaagcttggttttcttgcaatatggattagaataatgatattaaaatattcac

SEQ ID NO: 8426 - DNA, 612 bp, Homo sapiens
aagaaagagcattaaactagaaacgaaaaggctgaacaccattcctggtttaggtggacacacaagtggcctcaggcaaatcactggacttcttcgggccttagcttaccttgctgactgcatcttggctaaaactaaatgggaattattctaacaacccttcaagttgatgctattattaacccaattttacaaagtactttctccaaagtcacaaacaagaagtggagccaggtatgcagatctgacctctgggctcggttctcaatccttcgagttaccatctccaagtcccctgtggttctggttgtgaccatctctgcattcattcaaataggaaggggctgggactgccagcatctgcgggcatctaattagtacccaagtgtcacaggagaccctgctaaatggtatgagagagctgcatcctcctcagttgcctagagtaacagtacaaaatcctaaagccttttccatagctatccccaaattacgtctgggtcctgttctgataaggtgtttgggaataaagcagcagcacagtgacctttaacatagacccatttcgggccaggtgcggtggctcacgcctgtaatcccagcactttggga

SEQ ID NO: 8427 - DNA, 522 bp, Homo sapiens
ctaagacgactgaagggcgcaagattgaaacacctgaactgggctttaacaccccaatgtctacactctaccaacaactatttcttgccctcactgacaacccgccgctgtcatgcttgtaagcacaacgctccgttccaaactggagaagcggcgagagagcgggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagagactctgaaagaaaaggctttggtttttgaacacgtgcaaagtgagctaaagcaaaaacagagtcaaatgaaggacattgaaaaaatgtacaaaagtggatacaatacaatggaaaaatg

SEQ ID NO: 8428 - DNA, 510 bp, Homo sapiens
cagaagggcactctgaaatgcagattctgaaatgagttggtgcagtaagggatgagcaaaccatgttcttatactgcccccttccggcaaacggctggaagagacagcctgcatattttgtgttgaagaaactagttcaatttcatttaaaataaaacttcttttgtaatctctttgccccagccctgctgataggcagctgtaggtaatttctcttgttgcttgaaaatgttgcacaatatgaaaaaaacaataatgttaaagacaagacatctttggtgctctagaagggcaagaagtagggaaaaattactcagctgtatttgtatcaagcaggcacatggaagctgggaaaaaaacagaactccctccttggtttttgagaattgatggtgtgaaatttcctcagatgccaaaatcagctaaagcacaggaagattataaatataaggtaaacagaaggaataccgatcctagctttctttcttagtaagacagaaataaagaaag

SEQ ID NO: 8429 - DNA, 89 bp, Homo sapiens
tcagatctttagtctcccggacaagaatgaattctatggggatcggcacatataaagtcaatagcatgagcctgtgcttaagcttatgc

SEQ ID NO: 8430 - DNA, 440 bp, Homo sapiens
atgcctggctaattttttatttttagtagagatggggtttcaccatgttggccaggctggtctcgaactcctgacctcaagtgatctgcccaccccagcctcccaaactgctgagatcacaggtgtgagccatcgtgcctggcctgtttaatgaatttctgactggaggcttaatttttttgtttttttcacagggtctctttgagaggatgacagtgggaagcgcctactgtggctgttgcggctgcaggcctggctccttccactctcgggctgcccttcacggtgccaggtttgtggcagagcctgagccgccatcatggtgaaattctgctattgccgccatggacagagaaattaaaccgtggggttctgcttactaggaaactggagtaacacctcatctcaaaaaaaaaaaaaaaaaaaaaacggggggcagg

SEQ ID NO: 8431 - DNA, 512 bp, Homo sapiens
cccaggttcaagtgattctcctgcctcagccttccaagtagctgggattacaggtgtgcaccaccacgcctggctaattccatgcctggctctcttactgtaaatgagaataagaaagaatatactctgctgcaaagtcttagtataatagcatgtctcaaaatagaaaattgggcagagtgttcatagggtttcagagactcagctggatgttaaaatcacccagggtctaggctgggtgcaatggctcatgcctgtaatcccagcactttgggaggccgaggcgggtggatcacaaggtcaggagatgaagaccatcctggctaacaccgtgaaaccccatctctactaaaaatacaaaaaattagccgggtgtggtggcgggtgcctgtagtctcagctactcgggaggctgaggcaggagaatggtgtgaacccaggaggcggagcttgcaatgagccaagatcacaccactgcactccagcctgggtgacacagtgacactggtctc

SEQ ID NO: 8432 - DNA, 539 bp, Homo sapiens
ctgttcaatctagtgtgattctattgtcatcagagaacacactcagccagccccggtggctcatgcttgtaatcccagcactttgggaggctgaggtgcatggatcccttgagatcaggagttcgagaccagcctggccaacacggtgaaaccctgtctctactaaaaatacaaaaattagcctagtgtggtagcggacatctgtaatcctagcttctcaggaggttgagccaggagaatcggttgaatccaggaggcagagactgcagtcagctgagatcacaccactgcactccagcctgggtgacagaacaagactccatctcaaaacaaacaaataaacaaaacaaaacaacaacaacaaaataggaacagaccctgtactgattcaactaatacatttgttaaggtttgtttcattccccaaatatgatttatcttcatatatgtcgtgtggcaatttcaaaacagtgtattctgctcttttggtgtgttctataaatgcttactagatcctcatggttgataattttttcttt

SEQ ID NO: 8433 - DNA, 551 bp, Homo sapiens
ggcacgagaggtgttgaaattacagaagggaccatttctggcaacacagcagaccagatatcctataaaagtcttccattacagaacacctacacatcaggagctcaaaaacagatatattctttaaatgtctagccaacattttggaaaagtgtgggaaatccctcagggccaaaaccagagggagttggacaccagagtgataagcagacactgaaggcaaggccaacctcagggcttggctcaatattctagaactttacccttgttctcaagtctccgtgtggacaggggatgagggttacctggtttctgctcctttgactatggcatagactctgtagatgtctgtaattgaccgggaggtatgtagatgactgtatcaagttatcctcctgaccgggcgcagtggttcatgcctgtaatcccagcactttgggaggtcaagacaaggaaggaggtgagctgacagatgtgctggaagagcacaaggaacccaccagtcaggcatgatctcggagagggcgcttgtttgggggttactcagtgag

SEQ ID NO: 8434 - DNA, 300 bp, Homo sapiens
ctgccttccaacaaaatcgtcaagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggt

SEQ ID NO: 8435 - DNA, 300 bp, Homo sapiens
gacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagataagtcaaaaccccagcccaagattgggaaagcaggtg

SEQ ID NO: 8436 - DNA, 329 bp, Homo sapiens
ggcacgaggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcat

SEQ ID NO: 8437 - DNA, 257 bp, Homo sapiens
cgcttggggtgagtctcatcttcaccctttcaccaactgtcctggtaacaatctcccttccatttccttgttcttacagcataccccatagaatcaagcctcgttattgccagggctgaactgacttttttgtttttgtttttgatttaagcagtaccattgtgcaccttgggaaaattcctgtgttgatctaattttaccatattcttcactccactgaccactccaattaggatactcctggcactcttggtttt

SEQ ID NO: 8438 - DNA, 328 bp, Homo sapiens
tcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagtgctggtatgttgacctgacattagcagtgagtctgtggatccaggctcagtttcacagaggttgtataaacatggtctcaggtgggttcttgacacctgggttcaagcacaaaagtact

SEQ ID NO: 8439 - DNA, 222 bp, Homo sapiens
tcctattttacgtggttgttgagaggatccgatggaatgactagctgaaagtgtttgtaaaagtcaggataagtaaagcaatgctgcaggaacaaacaatccccaaatttcagcagcttactacaaaaaaatatgtatttctcactcatgttcatgtccaatgtgtgttagcaaggagatactgtctctcacagtcatgcaagaccccttgctggggaagct

SEQ ID NO: 8440 - DNA, 515 bp, Homo sapiens
ggcacgagaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaa

SEQ ID NO: 8441 - DNA, 439 bp, Homo sapiens
ggcacgagatttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctaagaattccaggctgcatctggcagaatcggtttggcaggggttcagctgctccctgggaggccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggat

SEQ ID NO: 8442 - DNA, 243 bp, Homo sapiens
gcagctatagcactaggcagccttgcatcctgggtgttgaaagtgcaggccattatcctcccctctgacctccaagatgttaggtggcctttctgtgcctcagttttatcatctgtaaattgggtatgattgtactagtgcctagtacataaggagtgctgcaaagattacatgagtgtctttaaagtccttacaacagtatctcacacatagtaagcatggcatgtggtagttactatcatt

SEQ ID NO: 8443 - DNA, 142 bp, Homo sapiens
tgcactccagcctacatgacagagtgagaccctgtctcaaaataataatactaatgaactgagactcagaaaagatgttagctcagggttacaaagctcacactggacagggcagcattggaaaccaaaattggtctgactc

SEQ ID NO: 8444 - DNA, 211 bp, Homo sapiens
ggcacgaggcagaggcagggctagaatgttggacttcagatctcttacttctgtgtgctagtgcaccattcttagtccagcacagacaattctcaaacagattagcaaaccaccctcttgaaattgcaagaattgttaccatgtgatcaaggcatcataattaatgcaaaccctagtttctagttgggaaagagattaagatggagacttt

SEQ ID NO: 8445 - DNA, 300 bp, Homo sapiens
gcttcagatggtcctcatatcttttgatccatcagcgaatccacagtggagaaaaaccatacagatgtgaggagtgtgggaagggctacattagtaagtcaggtcttaacttgcaccagagggtccatacgggagagagaccttataattgtaaggaatgtgggaagagctttagccgggcttcaagtattttgaatcataagaaactccactgccggaaaaaacccttcaaatgtgaggattgtggaaagaggcttgtacaccggtctttctgtaaagaccaacaaggagaacacaatg

SEQ ID NO: 8446 - DNA, 480 bp, Homo sapiens
ggcacgagcccagccataatggagcctgaaatcaggaattcatgtttcaaggttacatgtacaaatgtatgccctctcagaacaatggccattttgagaaagccagtgagagacagccagaccaggtcctctggcctagcacccaccagtgcctgccagctcagcccaagtctcctcacctaggatagcttgatggaataacaatgtattttaattttctgtagacctaaaactgctcttaaaaagtctattttaaaaatccatcattaaaacacagactttctccataataagaagttggaggggctgggcacggtggctcgcacctgtaatcccagtactttgggaggccgaggcagatggatcacgaggtcaggagctcgagaccatcctggccaacatggtgaaaccccgtctctactaaaaatacaaaaattagctgggtatggtggcgcacgcctatagtcccagctatttggg

SEQ ID NO: 8447 - DNA, 71 bp, Homo sapiens
actccatctcaagaaaaaaataaataacataataattcgagcatgtgatgactgactctagtcattatgga

SEQ ID NO: 8448 - DNA, 584 bp, Homo sapiens
ggcacgagcttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcagctggagttgctttgcatttcacagtacaaacagcagactatgtaaataattggcagaaaaattctactttgctgtggaattcccaaactaatatggaccagaaactagctaatcaaatcaattatctccaacaaactgtaatgtggctaggagattgagtagttagtctagaatatagaatgcagttacaatgtgattggaatacttctgatttttgcattactcctcatctgtataatgaaagacagcatgagtgggaaagagttaagaaacatttgaaaggtcatactggaaatttactttagatattatgcaactgaaggaacaaatatttcaatcttctctggcacatctgacact

SEQ ID NO: 8449 - DNA, 186 bp, Homo sapiens
gccattgtggctgtgcgagctcagcctcctggaaacccgccctgagcttggttaacagcattcactccaggtttagcccagctccaggttatcgcaggcaggactcccgagaacaggttcatgtttgctttttgggaggtgctgcgctaaagtggaaaaccaccctgggccgagtgggacctcccc

SEQ ID NO: 8450 - DNA, 531 bp, Homo sapiens
ggcacgagaatacacaatttacatgtcagaggatggtagaggaattgtcacttatgcttcagtctgacttagtgaagcagtggggccgagaaagcaatcatatacgcatttgtctcacatgagcagaggaacagagggatgactttaagttctgtctgttttttgtccacaaggaattttcttgtgggcaaattgtgaggtctttgtagctatcttattttaggaataaaatgggaggcaggtttgcttgatgtagttcccagcttgacctcccttttccttagtgatttttggttcccaagatttattttcttttcacagaataaattgtctttcagacccagagagcatcacagtcacattcagaaaggtgtccaaatgtaaatcacactttcacatagaattacagctatattaacaaattttttcttccattgtcttcatttgtaatatataaaaaacttaagcttttaaaaaactaaagttgaattatggtcttaaaaatgatggtcaatcttatcttcactggca

SEQ ID NO: 8451 - DNA, 466 bp, Homo sapiens
ggcacgaggactggagaagtcagaagtagaaaagcagattgctaggagagacaggatgacagattttggtcagaaaatgggatattggagtttaaagtatcaaatacagaatagttccagatgttcagagatccagcatgggattaggtactgaaatggattagaactaaaagtcactagaatttagaaattgagaaccatgagagtggatgcaatgacttgttgcttgattgaaaaataaattaataataataaaggaccatgagactagcctgttataggggttatctccatgaacattgaattttcccaggatcatagcaggaattgggtagagaaaaagattatgagaaggtgccagagtcttcagtgaatgtcaggaaattaccaggaagtcagcatatgacagagaaaaggacagtatgttatctgcatcaaaggaaaatgtgcttttgttgaaaagtac

SEQ ID NO: 8452 - DNA, 344 bp, Homo sapiens
gtcaagctggccctggatgtggagatcgccacctaccgcaagctgctgtagggcgaggagtgcaggctgaatggcgaatgcgtaggacaagtcaacatctatggagagcagtccaccgtcttcagtggctatggcggtgccagcggagtaggcagcggcttaggcctgggcggtggaagcagttactcctatggcagtggtcttggcgttggatgcggctctagtaccagcagcggcagagccactgggggtggccttagctctgtaggaggcggcagttccaccatcaagtacaccaccacctccttctccagcaggaagagctacaagcactgaagtgctga

SEQ ID NO: 8453 - DNA, 401 bp, Homo sapiens
ggcacgaggaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttacacacagcgggaaggctgctgggaacaggtggcagagaagtgccatgtttg

SEQ ID NO: 8454 - DNA, 374 bp, Homo sapiens
ggcacgaggccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctctctcaaggatgaggttttgaagattatgccagtgcagaagcagacccgtgccggccagcgcaccaggttcaaggcatttgttgctatcggg

SEQ ID NO: 8455 - DNA, 568 bp, Homo sapiens
cacgaggcaacatttgtctacaactctactgtaaaattggaaatgcttttccacagaaaaacctctcaaaatgctgaatgcaaaagttgggatcacagaaacattgtgcctatttttggtctgctggaaactgtatttttacaaggtaatccctgttttcaatatagttcctgtcttgccactggcggttttcttgtagcatttttctagttctgagattgctactacccaaagtattcatttctttcttactggggtgtcctctgtcttcacagcctgcttctggattgtaggttttttcctttctttctgttgagatatttatggcatttgatagagtcaaaccagatgtattgcagccggacatacttatgtggcttcagatgtgtaaaataagtaacttcctatctttgtctgtctagctcaagagttgactgtggacgaggaatgcctgtattgattcattaatgtaataactatttactgactgcctaccatgtacaaccagaaacacagttcctaacctcatgaacttaccatgtaacatgggaagacaagcactaagttc

SEQ ID NO: 8456 - DNA, 603 bp, Homo sapiens
gccctaaaagagatgaacaataccgtatcatgtggtatgaattagaaacccttgtcagagcccatatcaacaactcagagaaacatcaaagagtcttggaatgtctgatggcatgcaggagcaaacccccagaagaggaagaacgaaagaaatcaggaagaaagagggaagacaaagaggacaagtcagagaaagcagtgaaagattatgaacaggaaaagtcttggcaagactcagagagattaaaaggaatcttagaacgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttg

SEQ ID NO: 8457 - DNA, 227 bp, Homo sapiens
aactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattataaactatatcagctaaatcactggggtcttggctttatgtattttcaagcttaaaggaaatgtcaagctggg

SEQ ID NO: 8458 - DNA, 236 bp, Homo sapiens
tatgagtgagaaagcttaccagtgcagcgaatgtgggaaagccttccgagggcactcggacgttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatc

SEQ ID NO: 8459 - DNA, 589 bp, Homo sapiens
tcgcggccgctgctttagaacccccatgaagggggacagttaattgtctttccttgagttttcagtcaattcatgacactgtgcaaataggagaaataattatagttttgccaagtggcagaatatgtttgatttaatcttttatgacttataactgtacttagttgtgaagagtccattaatgttaattttgttatgccatgcatttgagagttatgcatagatttccttgtattttctccatattctatgtaaaatagctgtaactgggaacaatcattttttccttatttttgaagccaaaacaaaatatttcaaagtaaataatttcagctgtgtgagctgcaagtaggccaaagaaaacaagacagtttgttcttaaagttaaactaatggggaaaaaaaacaggacagggaggtatctcaagttcatttgagccatttttaaaattttggtagctggtttctgtttttcttctttttaaaatagtaacaacttaggattttgtgtgccaccagcttccattccatttcataaaagcttaatctagcaagaattggtgagccctagtagaagttagaaagaaat

SEQ ID NO: 8460 - DNA, 370 bp, Homo sapiens
attcggcacgagtgatgccttagtcacttggccacacagttttgtggtttacgagtcatgggaattgcttgtcttactctgactgctaaagttctgtcctattgtcttttcatgtaatagcaacatgactctgatgacaaagcccaactaattacacaacttaatttaatagtttaaagcgcaaagggcattccctgagcagtaaaatcttttgtttggaaattttaaaacaaattatattttactttatgttttatatttacgtaataagtatttacaagaacacaattttctcaagatttaaactgctcattgttccataaataggacacacatttagaaagaggatttttttttaaaggaatatttt

SEQ ID NO: 8461 - DNA, 705 bp, Homo sapiens
acttttctctagcatcgtaggaggaagaaaacaaacacatcagatattttcagcactaaaagagatggttttccccacatatatgtaaaagaaatttgcaagactactgggtatcagaatggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatga

SEQ ID NO: 8462 - DNA, 300 bp, Homo sapiens
  misc_feature 288: n = A,T,C or G
gctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaatagggaatgaagctgtcagaaatccccttgactctgcattctgtttcagagctggtgcggctctgcttgcncagatctgatgt

SEQ ID NO: 8463 - DNA, 300 bp, Homo sapiens
gcataagcaaaagtttcatggcaggagggagaaattagctatggccagagtatagagaataagggaagtatgatttgtgaggaggctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttga

SEQ ID NO: 8464 - DNA, 422 bp, Homo sapiens
acttctccctcagcccaatcccactgtcatcccctgctgtccacagatgctgatctcaaggacacacccagtaaacattctcagcactacgctgtctcaggttctgcttcctggagaacccaaattgtgtcatcaggaatcaatttggcattatcccttgggtatttaatcgatacccagtacaaaaaaaggacacaatgcttctgtcatttttttaactcattgatgaaccacagcagttttctcaaggcaagatagacaggggcaagactagcatctaagaggataaactctggcaggagggtttctgtaaagagacctaaaacccctcatagttcaggcaaataaacagtcaccataaggagccaagaatagaaatatatctaataagctatattcgccagggatgacaagtatggggc

SEQ ID NO: 8465 - DNA, 384 bp, Homo sapiens
ttatctctttctgttggctctcgaaagcctagagcaaaatgtgtggcccatctgtacagaatcttattgcttgcatttttagaagtaacctcaaggttcattttaactttcttatatcatttttcccattgtactcatttccttacctacttaaaaaaatgaaaagcaacttgtttttctcttcccaaatataaaatatatttgctatatgaaatgtgttaaatacatataagagaaaagaagaaagtgaaatgatctgtccttttcactgaccacatttagttcttgatagtttggcattttccaatgcatacatatacattttaaaaagtggcttattcggccaggcgtggtggctcatgcctataatcccagcactttggg

SEQ ID NO: 8466 - DNA, 338 bp, Homo sapiens
gacagaagggggtctcgaactcccgacctcaggtgatccacccgcctcggcctcccaaagtgctgggattataggtgtgggccaccatgcctggccaacgcaaggtaaacttttaacgtggaatagaaaaaataattttgttaaatccctgggatggaaataacatagcgaccaaaagagtacatctttctctcacatggcaaagttttcttcttgatgctacagtataaaagtaaaaagcacggtttcagtcttccaccagatgtttaaccccaatccccactgttgtttttcacaaagcttctgggatcacctgttccacttaattctcactgctg

SEQ ID NO: 8467 - DNA, 485 bp, Homo sapiens
tgaacctgaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttatcctcttccaaataaaaatagctttattgtgtcacatgggggatacgtagatatgcttttagatttttagattaactatctgtcaaatagaatcatgtcagtgaaagaactggccctgccgatgccagggtctggaagtatttaagaggtggcagcccatcggcatccttctagtatttatctttcattcctgaaattagaacgagggctgtgctgcagaactcgctgggccacatctagccctttggtggtgaa

SEQ ID NO: 8468 - DNA, 147 bp, Homo sapiens
gctggagtgcaatggtgcgatctcagctcactgcaacgtctgcctcccaggttcaagcgattctggggaggggaggaggagggaagcaaggagagaggaacgcagggagcagaacctgacctggtcacgggggtctgggaaagacag

SEQ ID NO: 8469 - DNA, 678 bp, Homo sapiens
tgctgtcggacatcacagcccctatgaagaaagtagccacaatctcaaataacaaaagggaatgttctaaaactttttcttccttaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatg

SEQ ID NO: 8470 - DNA, 168 bp, Homo sapiens
gaagaaggtggggaggaagaggaggaggaagaagaaggtgatggtgaggaagaggatgggagatgaagatgaggaagctgagtccgctacgggcaagcgggcagctgaagatgatgaggatgacgatgtcgataccaacaagcagaagaccgacgaggatgactagac

SEQ ID NO: 8471 - DNA, 370 bp, Homo sapiens
atacacttcgtcatttttttttctctgacagactcagcaagaccaattatattatctaagaactaaccaaggaggtgtatagtttagaagagtcaagaaaaacaggtaaaatatagcaaatatgtaaaacaaaagaaaagccactaaaatgcaaatttctgcctaagtattatatgttatatgctagagaacacagataatcatttgaccaagtaggaaggaaaacaagaaaatgaaaaaagtggaaagaagagaaagtttgtaaatgaaaaaagtttcaaatgctgagtttctaaagaactgagaaaaaaaattagaaacagtgattactaaagaggataaaattttttataaaccatgacattttgca

SEQ ID NO: 8472 - DNA, 402 bp, Homo sapiens
tgaatattttgatcaatgaagtcatacacttaacaatagctatcaatattgaggagctataaataaattctaattttcacaaaactcagtaaggtatgtaatacaacctccgctttacaatgagaaaaataagtcttactgattcgttgatttaatccatatcagagttaataacctctttttcattaaaattggtcctttaaaaacacacctgcagctgggcacggtggctcacacctgtaatcccagcactttgggaggccgagacgggcggatcacctgaggtcaggagttcgagaccagcctgaccaacatggtgaaaccccgtctctactaaaaaaaatacaaaaattagccaagcatggtggcgcatgcctgtactcccagctacttgggaggctg

SEQ ID NO: 8473 - DNA, 300 bp, Homo sapiens
aattccgttgctgtcgagcaaataccaaggcctaaaaaagaatgaattatttgctgtttgggaaatggaagcccacgctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccac

SEQ ID NO: 8474 - DNA, 358 bp, Homo sapiens
ccaggattctgccaggcaggttggcctcagaagccacacttcttatcccaataataaaagtgaacaagaacaggatgaagttagagtgagagagcgagagtggtaacactcatgcaatcagagaacaagagaaagctcaatggaaacatgtattcactgacaggattaaaacacaaaacaacaaaaagagagacggccgggcgcggtggctcacgcctgtggtcccagcgctttgggaggccaaggcaggcagatcccctgagctcaggagtttgagaccagcctgggcaacatggtgaagccctgactctactagagatacaaagattagctgggcatggtggggcatgcttgtact

SEQ ID NO: 8475 - DNA, 305 bp, Homo sapiens
tacggctccaaaaaacaacaaaagggtccggttgcaaaaaaacaacaaaagggtccggttgcaaaaaaacaacaaaagggtccggttgcaaaaaaacaacaaaagggtccggttgcaaaaaaacaacaaaagggttcttttttcaaaaaaccacacaaggttacgcctgcatgcagaccactgaggggtccctctgtgacaaaaccatcaacctttacggctgccccaataccaccaatgggtacgtctgcgccaaaactacagacggggacggtgtgagacctcaacagaagggtatgattttt

SEQ ID NO: 8476 - DNA, 176 bp, Homo sapiens
tgggaacaatccaaagagtctaagtttcttttccatccagcgtgagtttcctatttagtgaagtaaagctcaacttttatcaatagtttcattctcttgtggtatgtaaaacctacacacactcagaggcacccagaggaaactacactctgaggtattagtaaattctctgcaag

SEQ ID NO: 8477 - DNA, 508 bp, Homo sapiens
ataatcaagttatagctttacattgattgatatattcatagtgagaagagcatcttcattgacgttcttgattttaagaatcctagagaatcgtattttttaatactgaaaaatgattgtttactagcaattgttcagtatgaagtacaactagtttttttaaatgttatattgaaaaatgtttgatcttgtatatttggttttcaaatctgtttcctatacaataattttatattctaaatgtggaaaaatttgtattattttaaaagtagttgaaaatggtataatacaaaggcagtttaccaaatattctaggccacatacatttctatgaagtgtcgtatgcaacctttgaaatgtctgtggagagaacgtcatatggatgatattaatgctttgattaatgtagagcctttctgtgaaaacctatggccagttcaagtacccaagcctttctccttatcactaccactttttgaaattagaggtggaatgcttgaattctaat

SEQ ID NO: 8478 - DNA, 80 bp, Homo sapiens
ggacccagatatatacatttattcattcaatagaaattcattcttataatggccactgatacctatatcctaaatatttc

SEQ ID NO: 8479 - DNA, 335 bp, Homo sapiens
ctaacggtggagcttcaggtctgcatttttctttctctttttttagtgggcacagctatgatatcaaaaggtaggcctggaaccaagctgatgggagagggaagacctgaactggtcagtataagaaggaaatgagaaatgaacaggaatgaaatggggcgcgagtggtcagagagcaaagaaggaagtgtgggcagtgagtgcctgatggctgcggagtttctgtttcaaacgataaaaaaaaattttagaaatggacacaacattggccgggcacggtggctcacacctgtaatcccagcactttgggaggctgaggcgggtggatcacctga

SEQ ID NO: 8480 - DNA, 397 bp, Homo sapiens
tgcctggccccctctctgtactgtgtccacatccatcatttcccccaggctttattgagcacctgctgtgtgcgtccatctctgtttcccagagcttagacttcaaggtataggaattgctttgttttcatttttttttataatcctccaagatcttccagtctacttgaagaaacaaaagccacatcctgttttttatcctgtctttttgtggcttgctcatggcatgaattttctagctgtcaacaaagggaggggcgcttttgggctggaggagtcaagaggccttcaggaaaaaggagggcttttgatacattttctttctttccttcctttctttccttccttcctttctttcttttctttcttctttcttctttctttctttttttttttt

SEQ ID NO: 8481 - DNA, 598 bp, Homo sapiens
  misc_feature 535: n = A,T,C or G
tcaagagaaaaaaaaactagtttcttgcaagcattccaaggaggtccatcttgaagcccaacctgacagaatgtgaccagtagacttggccaagcccttccttatggccccaggaaactcccaagctatggcaccacaggaagcctatgcaagctgaggacccaagacaagttaaaaacaggttcaacggaaaaggctgagaatcactggcccattctgtacccatgcctttaaaaataatacccagctgcgcacggtggctcacgcctgtaatcctaacactttgggaggtcaaggcaggtggattacttgaggtcaggagatcgagaccagcctggccaacatggtgaaacccccatctctactaaaaatacaaaaaaattagctgggagtggtggcgcatgcctgtaatcccagctacctactcaagaggctgaggcaggagaatggcttgacccgggagggggaggttgcagtgagctgagatcgtcccactgcactccagcctgggcaacagagcaagactctgtctcanacataaataaagtttaaaaaaataaggcgcggtggctcaggcctgtaatcccagcactttggg

SEQ ID NO: 8482 - DNA, 622 bp, Homo sapiens
gtttttccctcaagaaaaagaaaaaaataaaacaaagcaaaaacctctgcctgagaaccatttaaaccatttgacaaatatttggttaaaacccccacctctgtcaaaaaggcaacagtactgtttattatccaggctggagtacttctgagaatgaaatggggtggtcttgatagttaagctgttttgggcaaatcagggcatttggtaatcctagtcataaagtatttctacatataatcatgctttccataacttttaaactgagccagtggtcacaaactcatttgtatcaaggggctaggaggcaacacaagagtttttaaatttttttttaattttttggagatggaatctcgctctgttgcccaggctggagtgcagtggggtgatcttggctcattgcaacctctgcctccccggttcaagtgattctcctgcctcagcctcctgagtagctgggattacaggcacctgccaccacctggctaattttttgtatttttagtagagacggggttttgccatgttggccaggctggtcttgaactcctgacctctagtgatccacccaccctggcctcccagagagctgggattacaggtgtgagccaccatgcct

SEQ ID NO: 8483 - DNA, 374 bp, Homo sapiens
ttgttatcaacaaacaggctagtagagtataaaaaataaaataaaggaaatgtagctggccgtggtggcatgtgcctgtaataccagctactccggaggctgatgcaggagaatcgcttgaacccaggaggtgaaggttgcagtcagccgagatctcaccactgcactccagcctggatggcaagagcgaaactccttcttgaaataataaataaaataaaggaattggggccgggcgtggtggctcacgcctgtaattccagcacttttggtagccgaggtgggcggatcacttgaggtcagaagtttgagaccagtctggccaacatggtgaaaccccgtctctactaaaaataaacaattagtcaggcatg

SEQ ID NO: 8484 - DNA, 377 bp, Homo sapiens
tctgtatatgtgttcaactctctggatgttaacaccttgctggctggccaccaagtgaagataaactggcctgggtcacaagtcttttttctgtgtctagttgcccaaggtggacacatctctgtcatgtctcaggaccagtaaactcaagctatgcttggaaggacagaattgatcaagatggaatgactcctgagaggagacagtagtgatatttctgctccactgctatttatttttctggcttcaaggttcagattcaaccatggcaggagagaaagtccttagcagtttcttattttatattttttttgttcctatgtacccctcattaataaaataatcagccaggcatggtggctcacgcctgtaatccc

SEQ ID NO: 8485 - DNA, 602 bp, Homo sapiens
gtagggacaagttagtgtggcccatatccccattgctgtagcagaaattttggcatctgtggcaggaaaagagaaagataaattttgatctttgtggaggagctcactgtccttgaatctcacctgttataaagaacataaatgagtggacattttctgcatgcctggatctttctacctgtgtttgtggtggtagcaggtgaagaagattgtgctgattcctttaaaggcatattcccaagatgcaggtgtgacttgtccagagaatatcacctgagaataaatcctagagaaggacgatgaagagaaaaatggctttttctcaggtgactgtgtctcagaccaggagcagtgttcacttctgcctcctggaatgccatatgtttagaacttacaaacctgtacttcttgactttatgctgtttctccctataagtttgtttaaacactttttcttctcatgatagtcaaacaactctgaaaaaatattttctatacactagagtcttctcgacattctcttcatcttggcttcttctctgctatgcagaattctcatcattaatttatgactcataatattaaaaatattccctttggct

SEQ ID NO: 8486 - DNA, 518 bp, Homo sapiens
ttatactcaaaagctgagttaactaattcaggaatataagtgatcaggtgtttccaggatttagtaacttagtatgttatatctagtaggtgtaactgtggcctacagtaggcactgttatattttttaaaatgaactcatccgagtctgttgcactggatgttctgtggtgaaaattatttgggttagagagcttttggcaacacaaaccatgctacttctgagtctctgaatgttgggattggaagtgtatggaaaacttgagtaagttcctggctctgccactaaatagatgagtgaacttgaacaacttatttaaactctctgagctcctgtttacttatctgtaaaatgaagatatttagagttaaaaacctaggatatttagacttaaatttagacttaaattggctgctgctttggtttcttgaaagaaatactttggtccttggcctccaaagcctctgcttagctgctttaccgattctatgtggtatgtcctcctttttaggttcttt

SEQ ID NO: 8487 - DNA, 361 bp, Homo sapiens
gaatatggagattggcagtggcagcgagaggttttggggtacagctccgcacactgattattgagtcagcagttaatggaatctgccaacacaaaactgaaatgagattccatgtaaagcctacacaatagaaaaatgaatgtttaatgagcatgaattgtatcataccatgctgtttctaaaagtctccaagcttagaggaaccttagagaggatcttaatgagctataataatagcttccattcgcaaactggtatgtataagtctaacatgtccacattagatcgctgctccctccaacaaacatggggaggctaagcagtttcctctcactctactaactgcaaagacagttcacct

SEQ ID NO: 8488 - DNA, 636 bp, Homo sapiens
gttggatattcctgtttcatttaaaaaatgaaaatgaaaagtttatcagctaaagattatagttaaaatcagcaggttctatatagcaagtctaagtattctaatggcgcttatattaatacccagacagaaatataagacacaaagcaagcctactaagcaaagcatctgactagataaagtagaaaaatttggcaggttccaaccctgaggtgtcagagtttattgctaataactcaagttgatttcttggctaaacagagggctttaaacaaagaaattttttggttctaattaaacaggaaccctaaactgttaacagtattcatactttattaatacaataattactaaaacatatcttagtaactagtattattgataactactgaacatgtgtcgaatgggaagaggagatcatcaccacatattctttaaatgtcagccgctttcataaaagaaagggttgatgttgttttctgtcaacagaatcaaatgaatcaattctggaaagtcttcctttcctctttggaatttatcttcattcatagaaactgtattcataggtcttaaattctttcttcttagactatagtactattacttggaatgattgagccactagactaaacacct

SEQ ID NO: 8489 - DNA, 225 bp, Homo sapiens
ttccagttcctgcttcataacagatgctcaacagatgtttattgattatgaaaaggatccctgaaaagctttctcctggaattagactctcagccctaaaatagagcaagcctgcagaaacgagaactggaggcttgaaagtcctccataactgggttgaagagaaaccattttcctgtaatcttttttttttttttttttttttaaaaaagaattttttttttt

SEQ ID NO: 8490 - DNA, 559 bp, Homo sapiens
ggaggatacagaataaaaactaacagatttcagcaatgaattacaaaaatgaaaattatttcagtagtaaagaccgaactaaaagaaattatgaaacatttagggatgaaaaagtttctaaaatgaaaaacacactggaagagtttaacatcatattagacactcaagaagaagaaaaacacatagcaaattttaagtcatagtttttgaaacattccaaatgaagtacacagatgggaagtgactcagtgagtttggggaaattatcaagcagccccagaaaaacagaagagaacacagggaactagaaacaatgtatttctaaatttagtaactgcaactcttgatataagaagttcagtgaaaccaaagccaaagtaagattacaaaattacattcagaggtatcataataaaatggttaaaagggattgataggctgggtcgggtggctcatgcctataatcccagtactttgggaggccgaggagggcggaccaccagaggtaggagttcgataccagcctggccaacatggcgaaacccgtctctactaaaaa

SEQ ID NO: 8491 - DNA, 436 bp, Homo sapiens
ttctttttaggtgtattataatcatttgcttacatcagtttcctttacaaaatttaggacagaaatctagtctgattcattctgatactactagagcatagtagaaagtagaatcttattaaacttctgttgatttgattaaaagggtacataacgaagtgaaggcagaaataaagatgttctttgaaaccaatgagaacaaagacacaacataccagaatctctgggacacattcaaagcagtgtgtagaggaaaatttatagcactaaatgcccacaagagaaagcaggaaagatccaaaattgacaccctaacatcacaattaaaagaactagaaaagcaagagcaaacacattcaaaaactagcagaaggcaagaaataactaaaatcagagcagaactgaaggaaaaaacccttcaaaaaattaatgaatc

SEQ ID NO: 8492 - DNA, 394 bp, Homo sapiens
ctcactataacctcaaactcctgggttcaggcaatccctctgccccaacctcctgagtagctatgactacagctgcacaccaccatcctcagctatttttttttattttttgtagaagcagattctcactatgttgcccaggctagtcttgaactcctggcctcaagtgatcctcccacctcagcctcccaaagtgctgacattacaggtgtgagccttcacgcccagtctaatttgctgattttaatgaacagcagctggttctattaggttggtgcaaaagtaattgcagtttttgcaattataattatcactgtgacagataattccatttcctaaatgagttggagatgggattagaaataaatacactttctttgaatcctcttatatt

SEQ ID NO: 8493 - DNA, 144 bp, Homo sapiens
gtgggaggatcacttgagctcacagaccagtctgggcaacacagtgagaccttgtctctctatattttttttaaagtagaagaaaaaaaaaagaagtaaactaagcttctagggcctttttgtttgtttggtttttttatcact

SEQ ID NO: 8494 - DNA, 467 bp, Homo sapiens
gctggagggggtcactgggacttatacagcacagtgggtctgataggtatccacacgaatgtattaactatttttttgttttttgttttctattttttgagatggagtctcactctgtcaccagactgcagtgcagtggcatgatcttagctcactgcaacctctacctcctgggttcaagcaattctccggcctcagcttcctgagtagctgggattacaggcttgcgtcaccacgcccagctaatttttgtatttttagtagagacgggttttcaccatgttggctaggatggtctctatctcttgaccttgtttgtgatccacccacctcggcctcccaaagtactgggattacagacgtgaaccaccgcgccccggccgaatgtattaacttttagcatattgtattagttgggaatgttcactttgttgctataacaaaaacaaaaatatcaatgagtaata

SEQ ID NO: 8495 - DNA, 537 bp, Homo sapiens
gtgggccggaggtcaccgagatctctcctcactgggggacggaataggcctctccctgcttgctgctgttctttggccttgtcccctgcctcctttcctggaccacctacaaggacctagagggaacagtactgggggcaggagctgggaaaggcctgctgtggttcactgctagtaagaaatagagactcagagaaatttcctgaaacacagcagactcttggcgcagccctttgagcagatgaaggaggacaagaagaagaacatccctcagctccagctgcatgccagaaacttcactcacattatctcatttcatctgcacagcagctcagcccagagtggagaggagtaaattggcccagaaagatcaagtaacttccttggagcttgtcagcgttgagtggaaacttggactctgatgtcgaactccaaaccccatgcttattctgtaaagcctgaaaagtgtcttggaattgctttagaagtaggagaagaggggaaccctgtgacattacactgtcttccagcataaca

SEQ ID NO: 8496 - DNA, 412 bp, Homo sapiens
  misc_feature 316: n = A,T,C or G
ggcacgagatcatctagaatcccagcagtttccttaagttgcctactgtcaattttccatttctctcgtccaaattcacatggagacatcatttttacacacttgtaatcaattgtaggcggagtctggggtcctagcacttcccctaacatcatctcatgatacttagacttttaaagaacccttgagtaggccctgtgataaaggatgttagtgaaaaaaataatgagaaacagggacttggcttagagaaagaagcctgcgtcagatcagtaggcccccctggggctgtggaagcatgcagaaggtcccttangaagtgatgttggaaatggccttgggccagccacgttatttctctggacctcaggtcacccatctctgaaatgggagcattgaactggctgatccc

SEQ ID NO: 8497 - DNA, 467 bp, Homo sapiens
atcttcagatgtctataattggaagcctatatagaaatggttgatgagcctatcggttgaaccactgcagagaatagagtgatggtcttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttataatttaggctgtggggtagttctgttatgatacatttgttttaaaatattctgcttctttttaaagtgagttgtatgtgtctttgttgtagggacgtgcaatttttgccagtggcagtccttttgatccagtcactcttccaaatggacagaccctatatcctggccaaggcaacaattcctatgtgttccctggagttgctcttggtgttgtggcgtgt

SEQ ID NO: 8498 - DNA, 500 bp, Homo sapiens
cctggcctcagtcatcaggccaggagaggtactggacgccgcgcacgcactcgtctgccagcgaggcccaaaggggaagcctagcggagctcagtgtggcagctgctggcctctgggccggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagc

SEQ ID NO: 8499 - DNA, 405 bp, Homo sapiens
ttactttcaggtattggcaaaaatcacagctggagtgcagattaagcatggtaggagggtggtgattggagaaggaatggaggggaaaaaggaaaaactacaaatcatgttaaaactgtcctcattgagttttacaagtaatatactggtcttatataccctttcctcctaccgtgggaaaatatcactaacttgtaataggattaaatgaggcaatacgtaagctttttagacattttctttatagagaacattattagaagttgttggcctggcgcagtggctcgtgcctgtaatcccagcactttgggaggctgaggcaggcagatcacctgaggtcaggagttcaagaacagcctggccaacatggtgaaaccccttctttactaaaaacacaaaaaaatt

SEQ ID NO: 8500 - DNA, 381 bp, Homo sapiens
catagaagggaagagatggaaatacacagagctagagggtaacacattgatgctacagacagaacacctaacatacttctggagttctgtaagattagaggagagaaaatagagcaagagaaatgttgcaaggatttttccaaaaggtataaaatgtatccctgaatatatttttagtaatctcaaacttcaggcatgataactaaaaccaaattaacataaaataatacaggacgcaaaagaccaatagaaaatctgaaaagtagctagaggtagaagatagagtatgttgaaaagaactgtattctaaatacaacctgattttaacagaaaacatggaagcaggaattcaatggattaatgggaatcatgtcttcaatg

SEQ ID NO: 8501 - DNA, 482 bp, Homo sapiens
accaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccaacactttg

SEQ ID NO: 8502 - DNA, 343 bp, Homo sapiens
agctacatgggaggctgaggcaggagaatcacttgaacctgggaggtggaggttgcagtgagccaagattgcgccactgcactgcagcctgggcaacggacagtgactccatgtcaaaaaaaaaaaattaattaattgcctctggcttaaacgtaaaagcatttcttggaccagcataaatgcataaaatctgtttttgttccagggggttgttaacaggactcatttttttggtctttgataggatcccggctactcaacaaaaatgaaggaggaatctgtaaaaaaacaccagtatccaaatggggaagtttggaaaaaactccttcctgctcaaaaaaat

SEQ ID NO: 8503 - DNA, 300 bp, Homo sapiens
  misc_feature (1)...(300): n = A,T,C or G
agcacaagagatgtaaaaaaaaaaaaaaaccccncccncngnggaangncccttttnaggtttngnttngtttttttttnggtttnnttttntgtttttttaatnntggggataacccntgatgncnggctanngtncatatcnggtcttttnagntagtgggctcttttaananntntnngctnaaannttaactnataaaaggttngagccncgtnancatncgncnaanggnacccangcataganaaaagganattcnnnccctgtgtatgaatgagcnggtcagattcaaggcag

SEQ ID NO: 8504 - DNA, 402 bp, Homo sapiens
taatgggacccagcatccctgccaaaactcgggaggtgctcgtcagccacctggcatcttacaacacatgggctttacaaggcatgtatggagtttcttgtgggcttggcaggtggctgtgaaggccatcagtgtctgaagcctgtacttgcccctccccaggtcctgtgagtggagaggcacagagtgttctgggctagctgagtgtggaggctgggtggctctgatgctagccaatcactctacgctctaggctcacacctttccaccttcgacttcgccagcagaagtcttgagttcaatctcattgccctggcttgggtcacatgtccatccatgaaccaatcactagactgggtgcggaaagctctgatttgccaagttcgggtcatgtgtctcact

SEQ ID NO: 8505 - DNA, 606 bp, Homo sapiens
  misc_feature 468: n = A,T,C or G
ggcacgaggccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgngctgtgcgacccctcaccctctcctcacgctgtgtcactgctggcaccagctgcctcatttccggctggggcagcacgtccagcccccagttacgcctgcctcacaccttgcgatgcgccaacatcaccatcattgag

SEQ ID NO: 8506 - DNA, 526 bp, Homo sapiens
cgttgctgtctgcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaaggtgagtggccggcagtggaaggctgttgctcattctgatttatgttggctctatttcatgctaacccagttttttttgtttgtttgtttccactttataacatatggatttctatgccacactacccgtaactttgaaaaataactttaagctgcagttttcagcaaacaagacagtccttagctgccacatagctcaacataaagtgcacaaaaaacttcacggtgggacagtgaatcataaattcccaaactgacgtgtgtctactgaacagatgagaactgttactcagtgtgtatc

SEQ ID NO: 8507 - DNA, 501 bp, Homo sapiens
taaatatcagtacaataaagaaagctagaaacataagtctaataatattggttggaagctattttaatgactatttaaatattttaaaggtgaatagtcaatgaaccaaacacttttgtaaggccactaagatgcatgtgtaatgtgtaatgcctccttttataaggagtcaatctgtaacatcacctgggctatttgacagcttcaaagtgaacgtgagaaggagagaaacagtgagagagatatatataaaaccagtaaaataaacataaagaatgaaggaaatatccaggcgccatggttcacacctgtaatcccagcactttgagaggccgaggcaggtggatcacctgaggtcaggagttcgagaaccagcctgtccaacatggtgaaacccactctctactaaatatacaaaaattagcctggcatggtggcatgcacttgtaatcccagctactcgggaggctgaggtgggagaattgcttgaacgtgggggct

SEQ ID NO: 8508 - DNA, 630 bp, Homo sapiens
aggctggagaatgccaccttctgaaatcaaacctagtaaaagtcaacacattataacaactatggtcataataactacaatttattgatcccttacaatgacaggctctgaagtaagcactttataccctttatcagataatgcttaaaacagctgtgtataatagtcacctatacatctgtatcaaaatatggaagctcctagggttgcaaaggtttcatctggggccaccagcctgtaagtatcataacaaaagttcaaatcaagtttctctactgtctgagctattgtctactaggctacatactaagctttgtctcttttagaggaaaactacagaaaaataaaccatcagataaaatcatttgtaaatatgtcactgatgttgacttgaaaaatatgtacttagaaatctaagagaccagggtataacctcaggtagacatgataggatcacatttgatagatatataacttcatttcaatgccttgggcatgaccaagttgtgcaattagtaaccagcaagaggtggagttgacttgaaagtccttgctggccgggcgcggtggttcacgcctgtaatcccaacactttgggaggctgaggcgggtggatcatgaggtcaggag

SEQ ID NO: 8509 - DNA, 590 bp, Homo sapiens
gtatacaaaagtcttttgtgtatttggtttgctaaaatcacctatgctgcatttgatttttgtacttcttacatttcttttaatctagaataatagagtctcattccattgcccaggctggtgtagtggtgcgatcaagcatcatagctcattgtagctttgatctcctggactttagcaatcctcccgcctcagcctcctgagtagctgggactacacacacgagccaccacacccaacctcctcccttttcttcttcatgccattgaggtgttgactaacgtatggtctctattagacaaacttacttatatccactaacttcgaggaatgactaatgggtggggatttcaggacaatcagaagtcagcaagaatgggaagacaaggctgggcatagtggctcatgcctgtaatcccagcactttgggaggctgaggcgggcagatcgcttgacatcaggagtttgagaccagcctggccaacatggtgaaaccccatctctactaaaaatgtaaaaattagctgggcatggtggcgcaggcctatattctcagctacttgggaggctgaggcaagagaattgcttga

SEQ ID NO: 8510 - DNA, 593 bp, Homo sapiens
atgcagccttccttcctgtctttggtgataaaaatatttttttttaagtattataaacactactattgttagcatgttctatactatttgacaaaatgttcttgttttcttcaagtggaggtttttcctagtgagagctatgtttggtcatgttcctctctcaggtgcctcagcaacctgaactcctccttcaagatgcattctatgtggcttggcaaaatagaattagcatagaatttgaaattctcaatttaaatttcacctgtgcaagtttctaactgtgtttaaacatgttatatgcactttgtaaatctgtttcttcatgaataaagtatagataataacaaaaaacaaatctcaagggatagtatctataggatcagatgagataataaattttagaaagtgataagcacggccgggcatggtggctcacgcctgtaatcccagcactttgggaggctgaggcgggcggatcacgaggtcaggagatggagaccatcctggctaacacggtgaaaccctgtctctactaaaaatacaaaaaattagccaggtgcagtggcgggcatctgtagtccctgctactcggg

SEQ ID NO: 8511 - DNA, 626 bp, Homo sapiens
tacttcttccttctagtctaccctgcacagccctcagagcttgaagaagcactgtgacacctgccgctgtttgcccttaggaaagatgccaagtttagaattggttttcgggtggtttcagcaaaacaatagcccacactgcctcctaagaagaatgactatgccaactacaaagagcactggagaaaaggacaattgttttatgtttccagtattcaaaaacttagcaaatggctgggcatggtggctcacacctgtaatcccagcactttgagaggccaagtaggatggatcacttgatgtcaggagtccgagaccagcctggtcaacatggtgaaaccctgtctctgctaaaaatacaaaaattagccaggcatggtgtaatcccagctactcaggtggccgaggcaggtgaatcgcttgaacctgggagacagagtatgcagtgagccaagatcaagccactgcactccaaatggcagcatagcaggaaggtttagagtatggatcctggggccaggctgctatatttaaatcccagccctggctgggcatggtggcttatgcttgtaatcccagcactttgggaggctgagacggatggatcacaaggtcaagagttcaag

SEQ ID NO: 8512 - DNA, 577 bp, Homo sapiens
gaacccagcatctaggaaaactcagcaggcttttagtgacttttccattcagcctcaatgcagaagaaaggcagtcttttgctcagaggcacaagaaagtgaagcatcaaggaaggaattctgaagaagtttttacaactttacatgcagctgggttttgtcagataaagaaggaagagaacactgcaggtgtaaagacaagatgaagaaagcaagaaggcgtggcgaacctatctggtacgaagtaagtagggcagtttaattaaagtgccagggaaaggtgcagaaaaagaaatccctattctggggcaagatttctcagtaggtcactcacatctcagttcatccagaacagtctcattttgtctctatcaacctggcacaatgattaatatctcctctttccgctcttgaaagtaactgggtttgggcaatatagtcattccactcaataggcaattcgagcatacagttagggcattaaaaaaatgcactcttggctgggcgtggtggctcacacctgtaatcccagcactttgggaggccgaagcaggcggatcacaaggtcaggagttca

SEQ ID NO: 8513 - DNA, 384 bp, Homo sapiens
atataccttaaagtagccactaaaataacaaaaccacgagttatacctaagaagctgacaaaggagataaagtggaattatatatatatgaaaaaaatttcatccaaagaaggcagaaaaagggaatatagaatagacaaaaagaacttggatccagatcaaacacatttaataaaaaagagaaatgaaaccatgtcaagccacctagttatattggggatgaacttagtcctgtttggtaataatggtagagtagttaatttttgccatcacaataaattaagtgaaaaagctgaagaacaatgttgacatcagcagtatttttgggactaacaaaggaaagttaaactataaacctaacactaaaagttaattgaagatatc

SEQ ID NO: 8514 - DNA, 344 bp, Homo sapiens
  misc_feature 142: n = A,T,C or G
cagtacaacagtaaaaaataatacaaattaaaaaaacccaatattgtataacaactatttacatagtattaggtattataagtaatctagagatgatttaaagtatttgggaggaggctgggtgtggtggctcatgcctgtnatcccagtactttgggaggccgaggagggaggatcacctgaggtcaggagttcaagaccagcctgggcaatatggtgcccaaccccgtctctactaaaaataaaaatataaaaattagctgggcgtggtggcacatgcctgtaatcccagctactcgggaggccaaggcaggagaattgcttaagtttgggtggtggaggtt

SEQ ID NO: 8515 - DNA, 604 bp, Homo sapiens
aaagataaatagtaccatgttaaggttgaataatttttttaatttacaaggaatctttaaaatcaggaataaatatttaattttattaattacttatcatcatctattaagctgatctaatgggtattttttctctcttggcctattggtggaataaattaccttactagatttcctaggttaaatcttatttggacatagattattgttctttcttttttttatttgtataaatgtatggaataccagtgtaattttgttacatggatatattgcatagtggtgaagtcagggcttttagtgtatccatcactggaataatatacattgtacccgttaagtaaattctcatcatccactcccctttcatcccctactcttctgagtctccagagtctattattccatactctatgtccatgtgtttatgttatgtagctccagtttataagtgagaatatgcagtacttgtctttttgtgtctaagttgtttcacttaagatattggactctagttacattcacgttgctacaaaagacatgatttcattcttttttatgactgaatagtattccatgttctatctatctatccatctcacat

SEQ ID NO: 8516 - DNA, 367 bp, Homo sapiens
cagagggatctagaatatctgccaaccacgttaccagcttccctcatgaattcaaacatcatctcccgcttctatgccttggtttcagcagaagcagcgctagtgctaactcttataggagagaatcccattccctggcctatagaagtcctttccctcaaagcccagtcaaccaccctcctcatttaaggattctagttttttcaagcattatagtctccagtcacctacataatatccctctgattggatggatctctgaggctgagaccactatattttccacaccatttttgagccccacccacctacctagcaagcaggtgttctagctgagccggagtaggaaaggcatggaagggagaag

SEQ ID NO: 8517 - DNA, 568 bp, Homo sapiens
gggagaacttgagaaataaagaaaacttcaaatgcttttaccaactagtagcatgcacttcttcatgaacactcagattaaaacttgattcacattctgagagtgactcaggagaggttgacaaagatctctctgttatttcgcagagttaaactctatgacactgcacaatccaatagactggccattagatatgagctaaaggagaaggacacatcacttagagagtttgttgttgtttttaaattgtgtcttgtgtgtataaattttctaagtttcaggaaacttattctgagtgtctttgagattgcaatctaaaaattatatactgcagtgaggccatggaaattgatatttcaccagccaggatcactaacaactgttgggccttcagctggctggaaggataaggtaataaagaggatagataaaagtggggctagccaggcgcagtggctcacgcctgtactcccagcactttgggagtccaaggtgggtggatcacttgaggtcaggagttcgagaccagcctgaccaacatggtgaaaccttgtctctgctaaaaata

SEQ ID NO: 8518 - DNA, 298 bp, Homo sapiens
actttttgatatcttacagtagatttttttagggagtagtgagcacatgaaactaaactttgactttagagaatatcagcacacaatgttcacatggtaatttcactctcaggaatttattctaagaaatagtgaaagatgcatagtgaatgtttgagagagacagaaagcaaaatattaaaaatatataataggtgaacggtaaagtaagttatgggtacttgtaaaagaaatattatgcagccattagaagtcagatttttgaaaaatatttaatgaaatgagactactgagtttt

SEQ ID NO: 8519 - DNA, 540 bp, Homo sapiens
tacctggtggggatgtatatcctggaggcagtctctccccctgtcacactctgaggacttacaatttttcacctggctcacagtgggtgtaggctgcagcctgctgcttctttcaaagggtctatggtttctgtttttctgttcagttcctgcattgcttcttagaaaaaagttcacagtatgaatttctactcaccattttgtctttccaagtgggagagtcatgctgacactgtttccaatccaccatcttgggaagaaaaacaaaacaaaatgtgatttttcttagcctatccacatggtagtttagattgattgattttcaaatatttaaacagccatgcatgcctgtaataaaccctacttgtaatcatttattactttatttaaatgtgatctcttttctttgaaatatatttaaaatagtctttgctaaatctattgtttgggattactcaaagatgatttctgttgacttgtttcctaagtaaagaacacactgctggccaggtgcagtggctcatgcctataatcccagca

SEQ ID NO: 8520 - DNA, 507 bp, Homo sapiens
aaagtcatcagattctttaccaatctggtttttttttccccctaaaacagggtctggctctgtcacccaggctggagtgcagtggcatgatctcggctcactgtaacctccgcctcccgggttcaagggatcctctcacctcaatctcccatgtagctgggaccacaggcacatgccgccacacccagctagtttttgtaaaaatagtgtttcaccatgttgcccaggctggtctcgaactcccaagctcaagcgatatgcctgccttggcctcccaaaatgctggggattacaggtgtgagccaccatgcctggtcaccaatctctttttatataaataaggctatctctggtcagcaccaataatagttttccagagataaccacatcctcatagctggcacttgtgaatacgttagattgcaatggtaaaaggggcttttgcagatgggactacattagggatcatgagtcaggagatgatcctggattatccaggcgggcccg

SEQ ID NO: 8521 - DNA, 339 bp, Homo sapiens
ggggtataaataaaacaaatacatttgaatacagttgaatatacaatatacaaaattttcttccaagtataaaacgaaaataaaatacactactttctttaatagaatagaacattgtaataatgttccattgcatttgaccctcacataaatgctatgaggtagcattaagagataagatttgaggctgggcatggtggctcatgcctgtaattccagcactttgggaggtcgaggtgggcagatcattaggtcaggagtttgagaccagcctgaccaatacggtgaaatcccgtctctactaaaattacaaaaagtagtcgggcatggtggcatgta

SEQ ID NO: 8522 - DNA, 472 bp, Homo sapiens
acaggatgtcaggacaagtgtatgctcccaaattgttgaaggaaatgttaatttctagagccttttaggaaaccaatctattaaaaccaaaaacatcttgtaactcagtaacttcatcactggggatttgtcccataatattaaaattccagtacacaagtacattttcaatgatatttactgcaacatttttcatggtagcaaaaaatggaaacaaagagaatatctaacaatagggaaaaggttatgtaattattgtgattcacaaatagaggattatgcagccattgaaaagaataaattacagctatactagttgatatgcagggattcctgcaaaggtattgagaaaagcaagttgcttaagtgtttatattatgatcatattatgatcctatttatataaaacaatgatgaaaatctctgttatatatatacacctacatgtatgcacatctgcaaaaatatgaaa

SEQ ID NO: 8523 - DNA, 449 bp, Homo sapiens
agggatcccagctccttgggaggctgaggcaggagaatcgcttgaacctgggtagcagaggttgcagtgagccgagatcacgccactgcactccagcctgggcgacagagtgacactacatctaaaaaaagaaaagaaaaagaaaaaagaaaacatttagctccaactggctgctaattggtcatatgtcaaacaacaaaaaagtatcttgttttgtttttaggtaaaagagatcaaacaatgtaaaagatttgatgcataatgtcattcttctagtcttaatacttcacctacaaataagcttatgacacctccccaccttctgttttaatcctgttctcgatactccttagaattcactcacttctcacgcctgtaatcccagcactttgggaggccgaggcgggctgatcacgaggtcaggagatccaggccatcctggctaacat

SEQ ID NO: 8524 - DNA, 536 bp, Homo sapiens
gttattggaaaagaaaatctatttgatttacataatgataaaacagtaaagaatgctgtgttcctctagttccctcatattgaggtatctaaaacccaaataaaaaatacatgaaaagcattttctcatcttttttaccttttaatcatttccctttagaacacctgtcatttctgtcaaaagatttttcataaacttagaattttattgcattattattttgagctttaagatggcaaattagaaatggcatatcttctttaaattattatcaaagcaaaagttcctacatatcagtaaggtaatgaataagaattatgttttttcctcatgatctccctattgtgcctattattatacagaacaaaaacaacaatgaaggctgggcgtggtggctcacgcttataatcccagcactttgggaggccaaggtgggcagatcgcttgaggtcaggagttcaagaccagcctggccaacaggtggtgagacccagtctctactaaaaatacaaaaaattagccgggcatggtggcgt

SEQ ID NO: 8525 - DNA, 472 bp, Homo sapiens
ggagtattgctgattgtgttaatttttatgcttatattccctaatatatatatgtatatatatatgtgcacatacatatttaaattatttccttgattaatcaaacattactaggattccataatatgaacgtattaatcctacttcacaaatagaacaaagtaagaggataataaagcaaaacagaagtttttcaaaacttcacaaatttaagataatttgatattgttagtgaataagacaagcacctaataaagatgtattaaatgtccaatatgtacttaatacaaaactatatgattctaatattataaaataagtaacttcaaataactcttcaagagctaatagcttatttattaaaataatattaaaatggataatactggccgggcacggtggctcaagcctgtaatcccagcactttgggaggctgaggcaggcagatcacaaggtcaggagatcgaggtca

SEQ ID NO: 8526 - DNA, 588 bp, Homo sapiens
gactccccaaacacagtttttccaccaacaaaaggttttcagtcctttaaattcatctaaggacataaactatgcagagcagtcaggatagaagccatgtgagccacaaacaacaaagcacaaattgcctccagtgggcatagagtttcagtgacttcatgttggctaaatataggcgaacacatggtgtgttgtgagtgccagggagaaccatgatgcaattatcccctccccttgatggaatagagaggaccagggtcagagggaagaatgagattacctaataaatggtcacgtcacggtcctcaactccactcccatccaagggttgcgcgcgcacacacacacacacacacacacacacccccaatacatgacaaagcaaacattatcacacagctttagaacaacatatttatcttctgattgtagttaaggataaattgctttaatattaaatttaattgttgtgattttctttttactccttattacataaaaaattcatattcaccatagaaaatttagaaatcagaataactattaatttttattgagcgttaatatatggcaggtattccctgtaat

SEQ ID NO: 8527 - DNA, 597 bp, Homo sapiens
tggtgtgcagagtgcagcggcacgatcttggctcactgcaagctgcaagctccgtctcctgggttcacaccattctcctgcctcagcctcccgagtagctgggactacaggcacccaccaccacgcccggataatttttgtatttttagtagagacggggtttcaccgtgttagccaggatggtcatgatctcctgacctcgtgatctgcccgcctcggcctcccaaagtgctgggattacaggcgtgagccaccgtgcccggctgccacaaaaaactcttaacagagaggctgcactaagggcttggccagctgaccccttcactgttctggtaaacagtcctgtgtcctggaagagtctcttccccatgaggcacgggtgcttccaaataccttgtgtctgacctgcttggccagctcatggtgaaaggtgcgggatgcagggaggaagtggggttttgattttgatatgtatttgggagtggggatttaccttgtgctcaacaccatggataacttaacctcctgaaaaatttaggcttaaaaaaaagtggaccaggcctggtggctcacacctgtaatctcagcactttggga

SEQ ID NO: 8528 - DNA, 485 bp, Homo sapiens
gtttcgccatgttggccaggctggtctgaaactcctggcctcaaatgatccggctgcctcggcctcccaaagtgctaaaattataggcttgagccactgcgcctggcctcatacaattttttactcaaactatttagtgttgtaaaactatattcctaaaatactgtcagatttcaataaacactggggcacactgttatcaccatttacacgaatctaacgcttaaccattgcaatgaatggttcattcaatcctggctcccaaatggacagaaataactccccccgaacctttccttgagaatgaaacttctataaggtgtgttcattgctagctacggtgaagttcattttagaatcacaagcccttggaacttcatgttaagagttctgcattcttggccgggcatggtggctcacgcctgtaatcccaggactttgaaaggccgaggcgggtagatcacgaggtcatgagatcgagacca

SEQ ID NO: 8529 - DNA, 422 bp, Homo sapiens
gaaataccaaaggccaattagcttacaaagagattttttacctcagtaataagaaaaaaaaaattaaaacagcgatgagatagatggcaaaaatcaaaatgattaataggagtctaagaaacactatacagaattataccaggcccagcatggtggctcacacctgtaatcccagcactttgggaggccgaggcaggtggatcacgaggtcagaagtacgagaccagcctggccaacatagtgaaacccagtctctactaaaaatacaaaaattagccggagtggtggcgcacacctatagtcccagctactcgggaggctgaggcagggagaattgcttgaacccaggaggcggaggttgcagtgagccgagatcgcgccactgtactccagcctgggtgacagagcgggactcttgtctc

SEQ ID NO: 8530 - DNA, 559 bp, Homo sapiens
ttctttccaactctcattccatagctttccctttttctgcaaactttctctgtaacaaatctggtatgagttattttgtagcatcctcaccgttactgaaggccactttgtctctggcctataataagcataggcttcaaccagaaatggcaagagtgagacctaccattcactaggtgtctactccaaataggtagtagtgcttagtgtgctgagtgctttacatgcagtatctgccactccacattgttttgaagtgtccagtgatttttgtgcactatcatgcatcccattcatccaggggaagcgaaatatatcatcagtactttagagatgatggatctgtatctctcattctgtttaagaatcccaaatcactaattaagattcccagactacttatgcccctctaggctctttcagaatgaggtgtctttagatcaggatgtatgttcattcaaatgcttaacctacccattcaccccttgggcttggttggagttggagcagcctttcaggctttcttattaagaaatttctttttcatggctcacgcctg

SEQ ID NO: 8531 - DNA, 99 bp, Homo sapiens
aaatatgcctctctactgttaatgatggcatgatttgaaaagcttaatttttttctttatgtatgtctacatctcttatattttaaaatgatgaacatg

SEQ ID NO: 8532 - DNA, 478 bp, Homo sapiens
tatttagagacggagtctcgctctgttgcccaggctggcgtgcagttcacgatctcagctcactgcaacctccacctcccaggttcaagcaattttcctgcctcagcctcctaagtagctgggattacaggtgcccaccaccacgtctggctaatttttgtaacgacaaaaatcacatgtaaccacacccaattacagcaaatgactgcaagaaactgtatcaaatttttttcttgttaatgtgtgctgcagacaatcttcagagaagtgacttatttctattggacttttcctggctaacattcctaagacagtgccatagctctacgtacctagatcaaagttgttggaattgaacaggaattctggtaaataaaagaactctgggataagttcttttacatctgccatattgtgctttgacgctgaataccaggcctcgcgcacactgtgaaacatccggtcagccaggtcaaag

SEQ ID NO: 8533 - DNA, 402 bp, Homo sapiens
aaattgtggttacactaatacaatttagaggagatcatcagtttgtcacaggttctcaagacatgaaaatccaccagagaggctctattagactcaatgcatcatttcacggaaggacatgtagagatccttcacgagaaaatcacttctttccttctttccttcctcttttcttttcttttcttcttttcttcttcctttctttctctttctttctttctttccttctttctttctttccttctttctttcttgacagagtctcactctatcgcccaggcttggtgtgcaatggtgctacctcggctcactacaacctctgccgcccaggttcaagcaattctcctgcctcagcctcccgagtagctgggattacaggcgcctgccaccacgcccagctac

SEQ ID NO: 8534 - DNA, 307 bp, Homo sapiens
ctttgctaaatgtttgcaatttctaagtaaaccttttatctcctaaaatgagtgttaagtgtgattttgtttttacttttggtgctttaaacttgagtctagtctaccaagctttccattttatttgctttgatggtggtaggggggtggaggtgtgaactgttgtctaaatgaaaccaataattttatgacctacatttgtagaaagaataaaaatgccactatgtctagaacataaaagaaatgtcaaaaacaaattagagatatcgccacagttgtttttaaattgtattaacagtgactaatt

SEQ ID NO: 8535 - DNA, 535 bp, Homo sapiens
agtcaataaatggaaaacaaatgagtttctgaagtgtcttcatcaaataatagaattatggccagtagtaaaaaaaagaaaaaagagttatggccagtaattacaatataatttataaagtttctagtcactccttcactgatagaatacagtaatatgtaagcacgaatgtgtttattaatagcctgttgatataatttatgaaaaaagtacagagtttacaacttttttttgaaattggctcctgagtaataaaaagtttcttgacattgattatctaatgagagctaagtatgtgaattatctaacagagttcaatattatttgggaataggttttagagcccttttaagttgaaaattgagaatgatcaaaacattcctaattctcttaaatcaccagtaaaatacgtatcactttatgcatagccttacaccttaatatgcatctaaagctgggcgcggtggcacatgcctgtaatcctagcactttgggaggctgaggcaggtagatcacctaagggcaggagtttgag

SEQ ID NO: 8536 - DNA, 78 bp, Homo sapiens
gaacagggcacgtgctttttccatcactatcccatgctccatggtggctgaatatatgacaagtgcttgtcatccctg

SEQ ID NO: 8537 - DNA, 437 bp, Homo sapiens
ggagctggcagggcatggtggctcacacctataatcccaggactttgggaggccaaggcgggaggatcacttgaggtcaggagttcgagaccagcctgaccaacatggagaaaccccgtctctactaaaaatacaaaattagccaggcacagtggcgcatgcctgtaatcccagctactcgggaggctgaggcaggagaatgaaccctggaggtggaggttgtgatgagccgagattgtgccattgcactccagcctgggcagcaagagcaaaagctgcttttttagtttatcttacctgcctgatctctatggggttagagtctgtgtgtactagtgcacataataaactcaaaagcaaagatggctagaaaatgatggttattatgtattggctgacttatttgacactcttaattatttgtcctgtggggtcat

SEQ ID NO: 8538 - DNA, 125 bp, Homo sapiens
gttcatccatgttactgaaaacggtatgattatctctttttttaatttttaaaattttctgattgagtaatatgtatttgtattttatgttattcgttcttgaaacaatggctcactctgtcacc

SEQ ID NO: 8539 - DNA, 291 bp, Homo sapiens
gagttttattctctcggacaagatgaaccaggaggactctagacatggatcagcaggcacactgatgatgggaatgtgttactgaaaacaaagagaagtaaataaaaatctacgcacggagcagtgatatctcagggtcccttttcctattcatgaactctgatagatctggcctgtgccccttccccacaccaattaagaaattgctgaatttccctctgacagaggaaaaaaaccaacttacccatggaacaaaagcccatgaaaaaaagacttaaagatttttaccac

SEQ ID NO: 8540 - DNA, 454 bp, Homo sapiens
ctgagctccctttgctggcctaggaaaagctagctggccaaaatggtctcagttttcaatgggatgcagttggacaagagaggatgcatcagacaagatcagtttgaccttggctgcaagaaggagcagaaggcaaatgctatcttccccagtgaaaaacatcactagccatccagggaggaaatctggttttctcaactggagaagatagctacagttcaaaagtttagagtcttcttcgtgaatacagttcctggcatcagttgagggatcagcgtagataagtggaagttcccacttatagcatgtttgatttctttcccccaatgcagtttattacctctaagtttatcctgtagctcaactcggactaataaagttttctctagtacagaaggtccatagaggatctactttattagtttaagtgggttttaattagtcaattagagaa

SEQ ID NO: 8541 - DNA, 482 bp, Homo sapiens
ttaggactgccccccaacctccttattcttggagcctgggcacacgcacagctgggtggcccttcagctgatactgccttaactgctttaactctgcctgctgtgctgtccaggcttctgcaaatagcccaggtgtggccatcctccagaggcctccaacattaactgtgaagggcccggaataaaacctagtattagtaggccaggcgcagtggctcacgcctgtaatcccagtactttgggaggccgaggcgggagaatcacctgaggtcgggagttcaagaccagcctgaccaacatggagaaaccccgtctctactaaaaatacaaaattagccgggcgtggtggcgcatacctgtaatcccagatactggggaggctgaggcaggagaatcgcttgaacttgggaggcggaggttgcggtgagccgagatggtgccactgcactgcagcccagggaacaagagcgaaactctatctc

SEQ ID NO: 8542 - DNA, 543 bp, Homo sapiens
cagcctgggcgacagagcgagactctgtctcaaaaaaataaataaataaaaataaataaataaaaacaatgtggttgaaactcaaggactgagtcttataagctctggagttgccagtgcacataccttttgtccattgcttataaaggttgccagattttagccgggtgtagtggctcacagctgtaatcccagcactcatccacaggctgaggcatgcggatcacaaggtcaggagttcgagactagcctggccaacatagcgaaaccccatctgtactaaaaatacaaaaattagccaggcatggcagcgcgtgcctataatcccagttactcgggaggctgagggagaatcgcttaaacccgggaggcggaggttgcagtgagccaagattgcgcaattgcactccagcctgggcaacaagagcgaaactctatctcacagacacacacacaaaattacaaaagcagaagctgcagggcctcttgaggcccaggctgagaactcccacagtgctactggtcaaagcaagtcacatgatc

SEQ ID NO: 8543 - DNA, 545 bp, Homo sapiens
tgtcaataccatcaatttactttgatttggttttttttttcttttcatgactagtgggtttgtacttggccaaaatgctctcttgagttgcagtcaaggccactggatttacatgtgctatctatgttagaagtatcacatgtgatcatgaagcagagagcaaggggcattatttaccatgcataccagacaaagcatcatttcttgttcactgtaagacagtaacgggaaaggtatgacctgtgaacactgcttataaagtcaattctttatatcatgattagcataatcacatttctcccctttcagaactcatttatctgctaatatatatctatacagacatacgataaatacagaaagactggatagactatctcaaagaatatagaactactgataaacaatacattgcaaagcaagtatgcaaatattttaaaaagtaactgtgtgtctataggatgctaaaaagaagcttctgagaaaaaaagagaaatattttagcaaccaagctaaattttagcacagaatttttcaagttacaa

SEQ ID NO: 8544 - DNA, 493 bp, Homo sapiens
gctgtcgcttcaattaaggaaagaagcagccccataagcatttttgtttgtccgtaattggccctattgcagaaagaaagaaagaaagttgccctcaaatgcgtgagacagcatggcaggctagggtgtaacagatgagttctgagcagggaaggtgaatgaagcaagtggatccttggaaagataaggtaaagaaaggatgttagttggaaactagcaatcaggaaggtcagctgctgcctggtctaggtagagtggcagggcagaggagggcttggctggatatggtaactactgctccatggatgggtagtgacagtccttgactcacgcttcagtccttttctccccaggcctaggacaccttttctctgtgctacttgattcatctctatgttggatttatttttgagaatccagaaaacctttaggctgactttattttaaaattgagaggagggcatagaaaacttcctttcttgtcattagcaat

SEQ ID NO: 8545 - DNA, 498 bp, Homo sapiens
gctatttaatgaatgttcactccatgtcaggcatgtggcatgttttcatctctaccagtaacgctgaactttcttcttgtgtgcatcagcctgttgttttcttttgtaaatgttctgttcgtgtccattatcaacttttctactagggtgtgactgtttctatgatatatttataacgatgtgtgtgtgtgtgtgtgtgtatacgatatttggggtaaatacttttcccagcttctttgacttttaattttgcttatactttattggaaatacagaacctttattttattattattattatactttaagttctgggatacatgggcagaacgtgcaggtttgttacataggtataaacgtgccatggtggtttgctgcacccatcaaaccaccatctacattaggtatttctcctaatgctatccctcccatagtccgccacccaccaacaggccctggtgtgtgatgttctgctccctgtgtccatgtgttctcatg

SEQ ID NO: 8546 - DNA, 552 bp, Homo sapiens
gaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcaggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaactcctatttgtttatggc

SEQ ID NO: 8547 - DNA, 420 bp, Homo sapiens
atgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaacttgttaacacagaaacacttcctgcgagcatat

SEQ ID NO: 8548 - DNA, 370 bp, Homo sapiens
ctgtggatggagttgagagataccacctcagaataaagagctaagaatcacagctattcaaagatggattagactgctttgggacagtgagttcttatcaccaggaagtattcaagcataggttagcaattgctgggtggatattgtagagaggatttgagatttagtttgcaattcaatcacctatctttaacatcctttccacgccgtagattttatggccttctttcattaaatgaaggctagaagggacattgaaataatttggtactttcctttgcctccagagagaagagaaaaaatatgatttctcctataaaatagcaattgaggtgtgagcctaatagtcttttttttttttttttaaaac

SEQ ID NO: 8549 - DNA, 631 bp, Homo sapiens
accccaaccctctctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatattttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctac

SEQ ID NO: 8550 - DNA, 236 bp, Homo sapiens
ttttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgtt

SEQ ID NO: 8551 - DNA, 507 bp, Homo sapiens
accagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtattgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctccta

SEQ ID NO: 8552 - DNA, 624 bp, Homo sapiens
caatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatctttaaaccaaaattccagctatttaatttcagcatgaagaattgcattaaaaacagagcagtgaatcattttatgaataataatgctggattttatttttaaaaattatcctagcctaaaatgtttaggatcatcatagcattaagagagatttatatttggtaagaaatcaaaaacatcgtcagttttcatgcttaaagtatttaggatcataatagcattaagaaagatttatatttggtaaaaaatcaaaaacatggtcagttttctagtggaaatttttcatggcactataaatctttagtaacaagattttctatgtttagtctttgtatatctttttt

SEQ ID NO: 8553 - DNA, 318 bp, Homo sapiens
attgccaacagaatactaacatttttctctttactccttttcctccaggtcctcatagataatttattgagcaatctgataactaaatttgagttatgaaactaatgcttaagagtattttctatttcatttcttccagatatgttggtaagacccgttcatatttgtttccaagtcataaagaccaaatcatgtttacagggtcataaaggagataacttcattttgagaatattttcagttgtgtgtactctctgaaaagaagattaattctatgtgatagggaccagtgtaatttttaaacactaattgggcttg

SEQ ID NO: 8554 - DNA, 455 bp, Homo sapiens
gtcaagtacttaagaaagaggaagatactcatccagaaaataagaggagcagggccaagagaagtgacagctgtgccccctcctgactgtaggagaacagaggctgtgtaggggaaggagggacctagcaacagaagatcatctgacagatctgagcacttagaaaagttgttaggaggccaggtgtggtggctcatgcctgtaatcccagcactttgggaggctgaggcgggtggatcacctgaggtcaggagtttgagaccagcctgggcaacatggagaaaccccacctctactaaaaatgcaaaaatcagtcgggcatggtagtgcatgcctgtaatcccagctacttgggaggctgaggcaggagaattgtttgaacccgggaggggaggctgcagggagctgagatcacgccactgcactccagcctgggtgacagagtgagactctgt

SEQ ID NO: 8555 - DNA, 256 bp, Homo sapiens
ggcacgaggcttcatccagccaaagaggtcgttgtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttc

SEQ ID NO: 8556 - DNA, 316 bp, Homo sapiens
cagatgccagtcacaagtcccaggcctctcatacttctgaccgactggctacaaatcaggggttcccactacctcctcagattagataatttgctggataaaactcaggaaaacattattattaagggcacaactcagcaacagcccagtagaagaggtgcacggagcaagcacggggggacgtggagtttctgtgccctcctagggtggcctcctgcccagctcacccttgtgtgtgcaaggtccccgaatcttgtagttagagtttctgtagaactcaatctctaatcctttccttttctcttcatttctcttc

SEQ ID NO: 8557 - DNA, 490 bp, Homo sapiens
gctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaagatgtctacctggtgaaagtatattttaacatgactgatg

SEQ ID NO: 8558 - DNA, 459 bp, Homo sapiens
aatgaccatggcacaaatttatttaaagctgaaatacttcacttctattaaagcagttggctgggtatattgtttttgctgaaattattactctaggaggtaaatctaggctttatttactactttgggaaagtacatttaaaggccatgaatcagaaactaggttacaaacgttaagactcaaaggatctgtatactgaggcctatatttccatgaagtggttctctactctcagcaaatctagtattgctgaatgttgtagcattataagcaggaaaatcatcttactgcacataatctatccccacagaaacctatgacatttaggtattatgcaggcatgtgtcttcagttggctgtctccttattttaaccatgtgtccctataaatacttcagatccaaaaggttttttccacacttcgttataaaaaagtactaactagcacatatctgcat

SEQ ID NO: 8559 - DNA, 269 bp, Homo sapiens
ggcacgaggttggccttttgtatacagatgtttacatgcaggaagtgcctgtgatgaattttggtttggtcacatgagttttatatgcatgcgcatttttggatgccaaacacatatgcagatgaaactaagaagccatatgctgagatcgctggcgatgaattgaaactagcctaactggctgcactgctggagtcatttgctcaaactactgcaaacttttgtttggtctactgaaaacattaatcggaaaggtacagagttaattt

SEQ ID NO: 8560 - DNA, 300 bp, Homo sapiens
gatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtga

SEQ ID NO: 8561 - DNA, 271 bp, Homo sapiens
tgggcaagttaaatagtcctaattgtccctgagttgttagagaatgtttgtgaaccactcagcacagaccttgacagataggtttttgttttttgcttttttgaagtacatgatatagacaggaacacagatttttaaatggtagctgttactaagtgtgggagagagctttgactctggcagtttgggatggcctttcaaaattgacaagtgtggttgtaagggttagagagtaaattggtgatgaatgatacactactctttggagaat

SEQ ID NO: 8562 - DNA, 377 bp, Homo sapiens
aaaaaataaaaacacattataaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacataccatgtgattctacttctgtgaagtcaagaacagacaaaactgaaatactcatgtaaggatgcacactaaggtagtaaaactataaagcagagcaagagagttattactataaaagctctgtcgagggacaggagttgcaattaggaatatacagggaattctgtggtgctg

SEQ ID NO: 8563 - DNA, 264 bp, Homo sapiens
  misc_feature 236, 237, 239, 245, 246, 248, 251, 254, 255, 257, 259, 262: n = A,T,C or G
ctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaaaaaaaattaaatataatttaatannanaaaaannanaanaanntntntanat

SEQ ID NO: 8564 - DNA, 523 bp, Homo sapiens
cctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaag

SEQ ID NO: 8565 - DNA, 234 bp, Homo sapiens
atatccacgtctcagtcggtggatgggtaatgggatgcccgcttcccctactccagatgattgatgaagaaatggaggtgtatggagatgaggtgacttgcccaggatcagagctttaagtgacagaggcaatattggaactgaggtttccctcattcaaaagccagtggtgcttgtttgcactgccacactggagcagactaactgagaccgctcttgatgggtccttttcta

SEQ ID NO: 8566 - DNA, 300 bp, Homo sapiens
gggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtccataatgc

SEQ ID NO: 8567 - DNA, 573 bp, Homo sapiens
agcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcag

SEQ ID NO: 8568 - DNA, 420 bp, Homo sapiens
tctctagtttgagacaaagagaagcgaagtaacaaaaggccacataagtgataaatagtggacctggagtttaaacctgggatccccacctaaatcagaaatacaaaatcaaccacttttttgatgatccagggtctatgtatatttattacatgtatgtatatatgtatatatatatgcatgtgtatatatgtacatacatacatatagatgtgcttgtactagtgtttttcccaccagatagttagcctttcttctccccttgctcacttttttttttttttttttgagatgaagtctcactcttgtcccccaggctagagtggaatggcacgatctcggctcactgtaacctccgcctcctgggttcaagtgattctcctgcctcagcctcccgagtagctgggattacaggtacct

SEQ ID NO: 8569 - DNA, 495 bp, Homo sapiens
gagatgcctacagctgagagtgaagcaaaagtaaaaaccaaagttcgctgggaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggc

SEQ ID NO: 8570 - DNA, 472 bp, Homo sapiens
ggcacgagactggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgcagatcaaagaccaaggcttgtaaccaaaacaagcaaaaagaaactttagctgtttaactatcacctctctaatttaaaatgcatgaaaattaatactttgtttttgtttttttttggaaacagtctcactctgtcacccaggctggaggtcgcagtgagctgag

SEQ ID NO: 8571 - DNA, 577 bp, Homo sapiens
aaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtg

SEQ ID NO: 8572 - DNA, 563 bp, Homo sapiens
ggcacgagagtaaattcagtgtttctgttgccgaagagtgtttattggttctttcactttcatttcatagggccctttcttctactggcattctcactttgaattactaagaagtttcttctaatatccctctatctcctttttctttctagttttagataaagctgtcaaaagaacagttatcatagaaatagaaacatttaaattaccggcacgatagcttatttcttgctgcaaccattcagaatatctatttgtcactgccttgggtgctttgaagtgaaactgtgcttagatataaaaagtttaaaactcactttgattacatgttaagctcacagtttttacactgcagttcctgaatttagttccatcaaaactgtatgactaggccacatgtgatggctcatgcctgtaatcccagcactttgggaggccaaggcgggcggatcacctgaggtcaggagtttgagaccagcctggccaacatggtgaaaccctgtctctactaaaaatagaaaaattagctggatgtggtggtgcgtgcatgtagtcccagctac

SEQ ID NO: 8573 - DNA, 300 bp, Homo sapiens
cgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggct

SEQ ID NO: 8574 - DNA, 509 bp, Homo sapiens
gcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttg

SEQ ID NO: 8575 - DNA, 352 bp, Homo sapiens
gcttatcctagagaataactctgtatgaataaaattgcttaattgagtctcttactaaataagtaactagtgccatgcttttgtgagctcttggtatggcccatattaccttgttttttgtttttgttattgttggtttgtgatagacttgctctgtcgcccaggctgcagtacaatggcacaatctcagctcactgcaacctcttgctcctgggttcaagcaattctcctgtctcagcctcctgggtagctgggactacaggtgcatgccaccatgcctggctaacttttgtatttttaatagagacaggggtttcacacgtttgtcaggctgggctcggacttctaactg

SEQ ID NO: 8576 - DNA, 177 bp, Homo sapiens
gtaaatacatttttcttttttatgtaattaattaaatcagggatatagatttgatctgtaatttgggtataattctaatctttgctgaaatcacatctcaagtataatgaggcaactttatgcaaatgtacttgttgtgacaacaataacattttccttttttttttttttttaaaa

SEQ ID NO: 8577 - DNA, 392 bp, Homo sapiens
  misc_feature 326: n = A,T,C or G
cgaattcggcacgaggctcatcctgcatcgctcggtgtctgggctgaagcagacactgctggcggagtccgaggctctgaccagctacagccaccgggtgttctcggcctgggacttcggtctctgcgggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggngtgcaccgtggagctgcaggagatgccccttgtccaggagttgccactgctgaagcttggggtgaa

SEQ ID NO: 8578 - DNA, 390 bp, Homo sapiens
ggcacgaggcggggcacagtggctcagtcctgtaatcccagcaccttgggaaggccaaggtgggaagatcacttgaggctaggagtttgagacaagcctggccaacatagcaagaccccatctctacaaaaataaaaattttaaaaagggctggggcatttgagctgggtcccaacagtagacaagtagaaaaggcatggagagggcataccaggtgggaggagctgtgtgcaaaggcctggagatggaaaagcatgctggccaccagcttctgacaagcagtttagtatgaacggtatgcagggaaagaaggaaggagggcagaagggtgcgcacgaacacccgttagtgtccttaaatgaccagcatgggaacctggtctctttcctg

SEQ ID NO: 8579 - DNA, 573 bp, Homo sapiens
tgatactgagaaacaagtaatgaagcttaaaagtgctgcttgtgctctgtgccaaaggcagcagagcacttgtctctggtctccatatacacttgacatatttaccttcagtattctgagtaagattttgattcatttcacacggaataacactcacctaccatgcttaaattaccgtacatattgtgagactttattgatcataaataagttactctcaaccttgagatctggcttcaattttctgtattctcattctttctcctttatatcagaagcttcataatagacaatgggggcaaatatggtgtggagaaataatcagtttatatttagatatttttaatgtagttatcacttcctaaaaagctaggaaaaagctgaaatagatgaaatagccacgcaccttcgtttctagcctcctttaggtatctgcccaaatatattctatactatgtcttttctgaccatagtattaaaaattcaattttgggccaggcacggtggctcacgcctgtaatcccagcactttgggaggtcgaggtgggcggatcacgacgtcaggagattgag

SEQ ID NO: 8580 - DNA, 491 bp, Homo sapiens
ggcacgagaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctg

SEQ ID NO: 8581 - DNA, 386 bp, Homo sapiens
ggcacgagattggggactgacatcttaagctctcacctggctgcagtaggaaaggccaaactgacgacaaaaaaaaaattctttataaagatgatatggtaacatgtatctttgccctgggtctgggtgggtccagtcagtctcaaatttacaagcatttaggaccctaggtaaaagctgctagtattcttttaaaagttatatttatgacttgcaatgataaaaaactccttccaattaaatggcattttataatattatgggggaacttcacagggttaaaaataccctcatacgttattgcatttgatcttcacaaaaagtgcattttaaccagtactctgggtgcaataaataatatgtaaaaatttaagtcctccaattcc

SEQ ID NO: 8582 - DNA, 528 bp, Homo sapiens
gttcacgccattctcctgcctcagcctcctgaatagctgggactacaggcgcctgccaccacgcccggctaatttttgtatttttagtagagacggggtttcaccatgttagccaggatggtctcgatctcctgacctcatgatccgcccgactcagcctcccaaagtgctgtgattacaggcgtgagccaccatgcccggcctatcttcactttattaaaaaaggaaacgagtgaggattacagccccaaatggacattttttcctgggtgctatgaaaaggaacaatggaaaggaaagggaatatttgtcttcttttgttttattgggtcgtgtttgtttgtttgtttgtttgtttgtttgtttgacagggtctcgctctgtcgcccaggctagagtgcagtggtgccatcatagctcactgcagcctccacctcctgggctcaagcgatcctccagcctcagcctcttgagtagctgggactacaggcacatgccacaacacccggctaatttttcctttttttt

SEQ ID NO: 8583 - DNA, 450 bp, Homo sapiens
gaattgtcctaaattatctaatccgctagtaccagaagaggaatttctgggttattgtggtaaagtttcatgtgatgaaccatccttgaattctctcagaataaacaccacatggtcataacatgttaattttattatttttttgtgtgtgtgagacggagtttcactcttgttgcccaggctggagtgcaatggtgcaatctcagctcactacagcctccacctcctgggttcaagtgattctcctgcctcagcctcctgagtagttgagactacaagtctgtgccaccacacttggctaatttttgtattattagtagagacggggttttaccatattggccaggctggtcttgaactcctgatcttgtgatctgcccgccttggcctcccaaagccgggattaacaggtgtgagccaccatgcccggctagcctaattttttttttt

SEQ ID NO: 8584 - DNA, 539 bp, Homo sapiens
gaaagcccatttcaagctttgtgctgcctcttgatctacctctttgtccaggtggatacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggag

SEQ ID NO: 8585 - DNA, 604 bp, Homo sapiens
aatactcccatcagttaactgtctcaggtatcaaaatatcccttcctgtatgtatcaaaactcatgctgaacaatgagttctgggttgcaaaagaggatttatttgttgcacctatccataagtctttgtccacaagttaaacaaaaacatacataagtgcagcgtgtgctctttttaagtacattagtagacatactactgagaggccacactgcacggggttaggtaagtggactctggagccagattgctagttcaaagatgtgcccttccatttactaagtgactttaggcaaactccttctcttggtgtctcagtatcctcagctgtgaaatggggatgacattaagaccgatttcggccgggcatggtggctcaagcctgtagtcccagcactttgggaggccgaggcgggtggatcacgaggtcgggagattgagaccatcctgccgaacacggtgaaaccctgtctctactaaaaaacaagaacttagccgggcgtggtggcgggcacctgtagtcccaactacttgggaggctgaggcaggagaatgacgtgaacccgggaggcggagcttgcagtgagccgagatcacgccact

SEQ ID NO: 8586 - DNA, 395 bp, Homo sapiens
ttttattctttatattagatattaactcacaatcagtgctgctgctttgtaagtttctacttcctctgtgaaatgtgcaatatcagcaatgtatgtacactgaaaagagggagtttttaatttattgaaatatggtagcaggctgggcgcggtgggtcatgcctgtaatcccagcactttgggaggccgaggcgggtggatcatgaggtcaggagctcgagaacagcctgatcaacatggtgaaaccccatctctactaaaaatacaaaaattagctgggtgtggtggcacgtgcctgtagtcccagctactcaggaggctgaggcaggggaatcgcttgaacatggaaggtggaggttgcagtgagctgagatcacgccactgcactccaggct

SEQ ID NO: 8587 - DNA, 511 bp, Homo sapiens
cgagattttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttatcttggaaacacaggtagattggcagataaacgggaacatgtaggtaccgcgatgttggtgcatgtccattactttgggataggctttctcagtctttcctcaaatgatagttgagccagttttccagtggcaattctgagtgacttgcgcttgtcttatggtgtggtcaagggacattcagaactacggaaaacttttactgaaaca

SEQ ID NO: 8588 - DNA, 613 bp, Homo sapiens
gtgcaaaaaccagatagccaggattatagcctgtgcttgattttaaggtcttgtttctttggatgttgttgattatgataactctgttgtaaaaaaataatgaatacgttttaggctatttgcagaaaggcgagagaattaattttgaatctgtgagtgataacagtgggttatcaagaaaaaaatctggagcaagtcctactaggcttctaagaagtaattcactcatatgctatgttaaaatttttctgttcttatctttctttctttacctttcctttgttctttaccatgtgctcccaattctctattctctctcttagcagtaactttatgcacctgccattttttttttgtacccattgcttccttgtattctccatccatcaatcaataagccttgggcttccaggactctgcttctttggatctaagcctggcctgctctctctgttatttgtggtgcatccaacctctaattttaactttgcttggccctatcatgtaaaaatgactatttagaacaaatcattttagcctactcaaactataggattagcacatattgaaaataggtctgtattaggacaatataaaatcattctggcttgag

SEQ ID NO: 8589 - DNA, 617 bp, Homo sapiens
tgtcagttgatggcagaaatgttcattgttaaagagccatttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaacccaaaagtataaaactcattggtaaagcagacacacaaataagaaagagaatggaaccacatgttatcattacagaaaaccaccaaactgcaaagataaacaaaggaaagaaagaaagaaaggaaggaagaaaggaaggaagaaaaaggattatttaaaattatcagaaaacaattaaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgca

SEQ ID NO: 8590 - DNA, 333 bp, Homo sapiens
gagcttggccttctcagacttccactgggagaactcagggtccaattaaactccagaaccaggtgagctgcaccttctcaggtatcaaaacacagggcccgccaggcacggtggctcacacctgtaatcccgtaagtttgggaggccgaggcaggtggatcacctgaggtcaggagttcgagaccagcctggccaacatggtgaaaccgcttctctattaaaaatacaaaaaattggcctggcatggtggctcatgcctgtaatcccagcactttgggaggccgaggcgggcggatcacctgaggtcaggagttcgagaccagcctcaacatg

SEQ ID NO: 8591 - DNA, 206 bp, Homo sapiens
agacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtac

SEQ ID NO: 8592 - DNA, 331 bp, Homo sapiens
gctggtaatttttgtatttttagtagagactgggtttcaccatgttggccaggctggtcttgaactccaggcctcgagtaatccacccaccttggcctcccaaagtgttgcgattagaggcatgagccaccgtgctcaggcttcccacaataatttttactttgacacatacagacttcaatatcacattcgtatgcaccacgctatatgggagaatatctgtcaagactcatgagttgttatgtatagagtgcttaaattgtggacatataaaataatatttctatccagatgcagtggctcacgcctgtaatcccagcactttgggagg

SEQ ID NO: 8593 - DNA, 265 bp, Homo sapiens
gaatgaaaacttagtctaatattagaaaatcagaaaatatagtttaccacattaaaaattaatggaaagaattatacaattacctcaacagatgcagaaaaagtatttgataaatctcataacagcaacttttagcaaactagaacttcttaacctagtagagaatatctataaaaatttgaccccagcaatcccattacttgttatatacccaaaggaatataaatcattctattacaaagataatgcacacatatgttcattc

SEQ ID NO: 8594 - DNA, 142 bp, Homo sapiens
aacataaccattcttaatttaactatttatattatcctaactactaccgcattcctactactcaacttaaactccagcaccacgaccctactactatctcgcacctgaaacaagctaacatgactaacacccttaattccat

SEQ ID NO: 8595 - DNA, 278 bp, Homo sapiens
tcttacaataatcctgtaagggaacatatacctctttttataaatgaggaaattggggcttagctaagttaacttgcacaaggtcacccatgtagccaagaagcgttacctagcttacattattaactcatgccacttttattttttgagacggagtctcaccctgtcgcccaggctggagtgcaatggtgcgatctcagctcactgcaacctccgccttcggggttcaagcgagtcttgtgccttggccttctgagtagctgggattacaggcgtgc

SEQ ID NO: 8596 - DNA, 191 bp, Homo sapiens
acgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagac

SEQ ID NO: 8597 - DNA, 538 bp, Homo sapiens
ccgttgctgtcggtttggtcttaggctaaaatccatgttttacggagaattcaagaaatttttaaacttcaggtagaactgtgttttttacaaatgtatagaaagcatagtgcctaatgcatggtagaaacatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactggg

SEQ ID NO: 8598 - DNA, 300 bp, Homo sapiens
aattccgttgctgtcggtttagcactcacatatttttgttcaatctttacttctcacacaaacagaaaaaggaaattatatattctgtatcaacaaagatttaacaaaacatccatacactacaactgtctacttactaaaattaagaattagtatattatcttttttcttcttatattaaaactatcttttcatacactattttaagtttatgaactgaaagtcttttagagataatttacttcaatgaactattattatttatattttataagcaaattgtcacaacttggtattagc

SEQ ID NO: 8599 - DNA, 277 bp, Homo sapiens
gcagttccaagtaggtaatccttctgagaagtcccacctttctgagcggctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttg

SEQ ID NO: 8600 - DNA, 542 bp, Homo sapiens
  misc_feature 465: n = A,T,C or G
tcacttttaattaagcaagaaaacttattttaattaatgagctcaagcttacagaaagagtgtgagtttttttctacaacttccaatcattcaccagcagattgatatagtctggttttatttctgatctccatggcctagttctacccaagacatacacctgcatctctggaattctaggtctgatttcaggttatttttgtaaatgttgatgaaaatcaaatgtacttgagttgaaaataaaactcatatttttccattcaaaaagtatttattgaactccctactcaatgctatgtactacatgagagactgggaatataaatgtaatatagatatcaatgatgtatgcaagatgcttaagttctgctggggtgggacacagatgaggagagggttaatcatacctacttaagaaaggaaaccgggctgagcagaaaatgaagttaatcatcatcctcattnttctaaatgcacattatattaggcatgccattattttaaaacaaccatgccattattttaaaatctccatggtagag

SEQ ID NO: 8601 - DNA, 601 bp, Homo sapiens
gcatgccacatggtactataccgttgcttaacacgggctgaaatataggctttaagatttctagtgatccaaacaaagtgtgaaacaatatcccttacaagattttatgtctctggatttaaaacaaaccagcaagtggagcatgaatagatagaccattagaacggatacagagtccagaagtgaactgctcaataaatgactgtgtagccacctggacaaaaaaattaatttggatctatacctcaccctatatattaaatcgattccaaatggatcaacttttaattccataagacttaaagtctaaatgtccatcaatagagaattggtaaattatggtatggatatacctgcaataatatgttaagggggttgaaaaaacagcaaggagctctctatgtgttactataaacatgccccccggatacattaagtaaaaaacacaaggtggagtaaatatgtatggcatgccggcatttttctaaacaaggaacacaaagggcatatcttggctcatatatacataaacattttgaagaatgagcaggaaacagtggtcacctatttgtgacactaggacaggtgtgagggacatctt

SEQ ID NO: 8602 - DNA, 578 bp, Homo sapiens
ttaacacagtgaaaccccgtgtctactaaaaatacaaaaaattagccaggtgtggtggtgggcgcctgtagtcccagctacttgggaggctgaggcaggagaatggcgtgaacctgggaggcggagcttgcagtgagccgagattgcgccactgcactccagcctgggtgacagagcaagagtccgtctcaaaacaaaacaaaacaaaaaagaaaaaagaaaccaccaccaaccaaccaaacaaaacccaaaaaacccaaagtaacggaggtggccgagggagctggggatggggagggagtccaaacacctgggagctagaagtttctgaaaactgtaagtcttttggtgtcactaaaagatacaggatgaatgagcggggattaactgaagaagatagggttgatttataaagtttgaattcgaggccaggcacagtggctcatgcctgtaatcccagcactttagaaggccgaggtgggcgaatcatctgaatcacctgagatcaggagttcgagactacacctggccaacatggtgaaaccctatctctacaaaaaaaaaaaaaaaaaaaaaaa

SEQ ID NO: 8603 - DNA, 436 bp, Homo sapiens
tgctgcattagcacccaaccgccagctagacccagtagagtaaagtgagggataaaacggaaggtgtgcaagaagcatcggggtcgtaggttgtctaatcttttgctttcaggaaaaaaaaaggcatcagaaatagctgaatttccacagggaaaacaatggagctggaccctaccccacacgatatacaaaaaccaacctgcacggatcagagccccaaacatgaaaccagaaccgaaaagcttccagaagaaaatgtgtcagaatgtctttgctaccttcagataggcagagatttcctggaggaatgcaaaaagcactaatcccagaagaaaagaaaatgacaaatttggcttcatcaaaataaaatatgaatgttcataaaaagacactccctgggctgggcgcagtggctcacgtctgtaatcccagtagt

SEQ ID NO: 8604 - DNA, 441 bp, Homo sapiens
atccacccgcctcagcctcccaaagtgctgggattacaggcttgagccactgcgcctggccgccacaggcccactcttaaaaagataatgcataatataagattttgtttttcttttcttttgtttctttctgctctgacaggtaactttgattgtcattgacagttttaagaattcagtaccaaccactgaaagggtatgaatatccttgcttaaagaaagttaaaaagaccaggtgtagtggctcacgcctgtaatctcagtactttgggaggctgaggcaggtggatcacttgaggtcaggagtttgagaccagccaggccaacatgatgaaaccccatctgtactaaaaatacaaaaaattagccgggcgtggtggtgggtgcctgtaattccagctacttgggaggctgaggtaggagaatctcttgaacatggga

SEQ ID NO: 8605 - DNA, 331 bp, Homo sapiens
tactatattataagagtagacaaaaagagacaaaaatctctgctctcaaagagcttaaatgctggtgggagctaagaagcagataaaaaaaggcgaaataatggttacttcaatttagcatataccaagtgctaggtggtctcctgagtatctactaggtattacttaatttaatcctcccaacaactccatgaggaaagtattactattgtgcatatggggaaactgagacacagagagattaagttacctgctgaagatcatgcagctcctgaaggcagaaccaagatccaaacctgatggtcttggtacaaagtccatggtctaatta

SEQ ID NO: 8606 - DNA, 53 bp, Homo sapiens
gggaaaccgatacctactgcatccccatggaatgtacacaggtactgccctgg

SEQ ID NO: 8607 - DNA, 591 bp, Homo sapiens
gtgctagcccagggttgggctacggaagcactctgttacctgctgctgtttctcagaagtgagccctttggcatggagagctggaggaagaggacgaatgctcaaggtctcagggctggagaggaaatcatgatcatggggtggcaaaggacctcaaggcactgccagacactctgggctcttggagaactgttcagagttggcgataactttctgtaatcctaggcatctcttctcttgtcacatttcattgagatatctgtctatcctatttaacccaagcctgattttggataggatccagaaatctaggtgaatttcaggggcctggttgcttcctcatctagcttggtggtaagaagctcagcccctctctgtgggccatgtggagagtacagaaaataaaactgtatcagggccgggcgcgatggcccatgcctgtaatcccagcactttgagaggctgaggtgggctgatcacttgaggccaggagttcaagaccagcctggccaacatggtgaaacctcctctctactaaaaatacaaaaaatagctgggtatgggggcgggcacctataatcccagctactc

SEQ ID NO: 8608 - DNA, 445 bp, Homo sapiens
gtttacatataaatctccaccccacctaaaaccattaaatccttgaaatgaaatacctttagcacttaacatatgcctgtcatctgggagttggtgagcctgtgggatgaatgaatgtattctataaaattgcaacacttacaatagttaggcttatctaaaaaaataaaataaaaaccaagacttttctagcattccaattcctaagtcttcattctgtctcttttggaatggacttctccagtgactttttctttctctaatcatgcaaatgacaactttgtagcatcttatttaatctatttatttatctttatatagatagtggaccagatttctgtgttctacaattccaggagagtataatgggaaataatattacatagatgaaaagagacaattacttgggaatgttccaagagaagatggaattaagctccctcag

SEQ ID NO: 8609 - DNA, 554 bp, Homo sapiens
gagaaaaacaaaacctggtctgttctaggacctgtgtttccttaaagttttaacacaagcgactccagtttggtttggtttggtcttttgaggcctagtgcataagctcaatccaaaacaatggcctcccacaattttgttttttaaaaaattccctttttggtcagtttctcacttagatgagagtatgaccaaaacttagggccttagcgacgctctcagttaccatcattttgggtttctggtctcagcctgtcattcatcagtggccttatagtcacacatttctttcagctcttgtcattccagttgaagagaaaccatttgacattctagagatggctgcatgcaagcatttaaaacctctgggagggccgggcacggtggcttacgcctgtaatcccagcactttgaggctgaggtgggcggatcacgaggtcaggagatcgagaccatcctggctaacatggtgaaaccccgtctctactgaaaatacaaaaaaaactagccagtcatggtggcaggtgcctatagtcccagcacttgggaggctg

SEQ ID NO: 8610 - DNA, 117 bp, Homo sapiens
tgagcttttcattacattgttgaaagatgaagaacgaaagctacttgttgatcagatgaggaagagatcccctagagtaaatctgtgcattaaacctgtaacttcattttatgatat

SEQ ID NO: 8611 - DNA, 266 bp, Homo sapiens
acagggtctgttgggtgactgactgattgaatgagcaagacttctagttatacatagactgaaaacttccacttatctctgcttcttttcaaaatcccactaaaatatgaataaatgcatgttttaaagacaaaaggaggccgggcgcagtggctaacacctgtaatcccagcgctttgtgaggccgaggcgggcggatcacctgaggtcgggagttcatgaccagcctgtccaacatggagaaaccccgtctctactaaaaatac

SEQ ID NO: 8612 - DNA, 440 bp, Homo sapiens
gaagacgacagaagggtacggctgcgagaagacgacagaagggtacggctgcgagaagacgacagaaggggtggatcaaagatttaaatataaaatgacaaaacttctaggagaaaacatacaagaaaatcccgatggcactggcagatatctcttagatgacagcaaaagcacaatttataaaagaacaaatggataaattgaaccacatcaaaatttaaaacttctgtatttcggccgggcgcagtggctcacgcctgtaatcccagcactttgagaggctgaggcaggcagatcacgaggtcaagagatcaagactatcctggacaacatggtgaaactccatctgtactaaaaatacaaaaattagctggtcgtggtggcacgtacctgtactcccagctactcaggaggctgaggcaggagagtcgcttgaaccc

SEQ ID NO: 8613 - DNA, 68 bp, Homo sapiens
ggactggagaagtcccaccttcttcttgactacttctgccaaatgtctgtggggtctccaagataacc

SEQ ID NO: 8614 - DNA, 586 bp, Homo sapiens
agaaggggcctggcattgtgttgagcactcttgggaatttgaggcaactctattacccttccttggcctcaagaagcttagctatccccaaaataagaggaggcaaggaagaattaggagagttaagagtccttgtgaagcacttaaagactaaaaagctaccatgagtctataaaggcagattctctgaggaccacaggtatataagaagaaaaggaagtcttgattcagtaccagcagaggatctggttcggaagatgaagtgtgtttgagacgttaattaacaggaaccagagtcccagctgactctcgagcccaccctcatttctagtcccggctttttccactaacctgccctgctttttaaatgaatacccaagacagtctcatagcagtgatattctttccgtcaccctttggggaatggggagagacatggacccttgctccaaagccatgatgcctaaactcctgcctttcccaactaacaaggagcacaactataacctcaggaaatttaagttttaaaaagaaatcagatcgggctgggtgcggtggctcatgcctgtaaccccagaactttgag

SEQ ID NO: 8615 - DNA, 483 bp, Homo sapiens
gtaggggggataactaaacctaacagagaattaggaagctgttctgaagtgagatcaaaaggcctcagtgggtaactcaataaaccagaaaggagtctaaattaacctcttaagttaacttagtttctctttgttactctttgcacttaagttactcttaagttactctttgcacaaaaatgcatcttcccctttcaccttaaccatcctaagagctaatgaaaaacgacctttggccaaaaggtccaggatgtgctccttattctggaaatgcaatagcgtctcacctcaccaccctgtccagtagttgtggcttgttacatgaaaattaacctgtcccttagaattcacatcatgcggctgggcacagtggctcatgcctgtaatcccagcactttgggaggccgaggcgggctgatcacgaggtcaggagatcgatactatcctggctaacacggtgaaaccccatctctactaaaaata

SEQ ID NO: 8616 - DNA, 536 bp, Homo sapiens
attccttatcaatccatcatagtgaatttcagagtggcccctcaataaacacatgttgaaatgtttgctaagagagccttgtggctacttccaaatttttcttctgtaacctgaaagcccaggacaacaatttctatggcagtgctacattgggtaattatttcttcctttctttttaagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggtatgttaaactagttaatctcttttgtaataatttcaggaggtccttgttaatatatagtagaacagaaacagtttttacttatttaaaattcatacctgcttcttctcaaaggttttcagcatcttgatagtcagagggaaacattgtagtaagacagtctcta

SEQ ID NO: 8617 - DNA, 404 bp, Homo sapiens
gaactgcaggactcaggtccacttgcccagcagctggcagggaagggccatgaggcagtagagtccctacaggccaagaaactgagcagaacccatgcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaagtctggtccagaatctgttccaccaggatctctttcaaatgtct

SEQ ID NO: 8618 - DNA, 259 bp, Homo sapiens
aactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaag

SEQ ID NO: 8619 - DNA, 362 bp, Homo sapiens
agcccctgagctctgggaaagcctttctgatgatctcaagcttgcagattctgtccctgttctgaccgggggtcacagcctattggtagaacaggacctcctgctaagatgctggaaggaccctttgggggagctgaggcctgtctcccctctccccaggcgcaggtgcacaggcgtgtgggctgtctgcaagcacagatcctgcctcacagcaccattaccacaataactgaatctgtgtttcctggctgctgataattgtgctagagatttggggcatggttatggggtgaaggttagaaatgagcaattagccctcaaatgttaaactaataagggaaataaatgatcaagcaaagtct

SEQ ID NO: 8620 - DNA, 220 bp, Homo sapiens
ggcacgaggtgagacaccgtctcaaaaaaaaacaaaaacaaaacaggtcaaaaatcagttgcacaagttgtatgaaaccaggtattctgcagctctgtctcttgtttattaagatatgcacagtttctgaatcaacaaatatatctgtgattcttttatactactacataaaagaacaggagtaattcttgccttataaattaaatgtcaaacatttcct

SEQ ID NO: 8621 - DNA, 257 bp, Homo sapiens
ggcacgagtgcacgcctgtgatcccagctacttgagaggctgaggcaggagaatcacttgaactcgggaggtggaagttgcagtgagctgagatcgtgccactgcacgatccgcctgagcgacagaatgagattccatctcaaaaaaaaaagtacataatacctactttaaagattgtcatggaaatataaagtatgtggtccttactaatgctaaataatgctttgctttcttttatttgcatcttaccctcttcc

SEQ ID NO: 8622 - DNA, 636 bp, Homo sapiens
tgaacctctgatcattcctattggcccctgggtgagaggcgggaggcatggggggactgaagtttccagttggccagtgagcgaagaaggcgttggctgtaggccactatgatttgctaggagaaatttgaatgggtatgccagggcaattttcacttgcgagcaaataaccagggctctatccgctcctgcagagaagcgttggaggtctcttttctttcttgattgtccctaggagcaatctactgatatccttgcccagaaaaacagatgttttccgattcaaaatcagaaattgagtgcctgctgtctaccctacctcgtgccaactcaatgaaagtagagaagtaaaatcttaccgatttcaaacatacgcagtcttaactgatttcattatggaacctcataggaatacagatttattgtagcagcataaacttttcaataggcttctgtgggtgcgcctttgttcaaaaagagcccttgtgtgtatttgtgtatatatacacgtttacaaacaccaatcacaggaggaatgtaaatattccactcaacactttacgaacagactaaggtacttttaaaaaattacaatgttaggctgggcactgtggctcacgcctgtaatcctagcat

SEQ ID NO: 8623 - DNA, 102 bp, Homo sapiens
ccgcctttccaacctcataggctctatctcctcccaaaccctgtagcccttccagttgctggtcactgacttccattaattggcccggtggccttgcctgcc

SEQ ID NO: 8624 - DNA, 629 bp, Homo sapiens
atcaaatttcgatttaagaaactccaaaaataacaaaaattggaaacagcctataacattttaggaaatcaagaaatatatttaattgtaacacccactttcatattccacaagagaaaaataaagcaaagcctgatcaagacgtgcctttaacacaactcaatcacctttgagccttcattctttaccagtctctctattctctgtgcctattttctactctccctgagcagaaatttaagtgtcacattttgccaaggcctccattacatgagtaatgagtgcttacatatattgatatcccctgattttctgttggtgaagtttccaggaacattcattctcttgggaggagtagagactcaggtaaaagtcatgtctcttcatcttccacccttcagagattactggtggccagaacacctatgtgggagagtgggtatgggaagtggggtgtgtggataaagaaactctgttcgggagaggctcccagggatctgtgagtcagaggagtcacctatctttagggttgcacaaatctagcaccttctatgaaaactgcattcacccagaatgtgaaaagaaaaaagggatggctgagaacttttaaaattcagcaacagacacct

SEQ ID NO: 8625 - DNA, 646 bp, Homo sapiens
ttcagtgcctctggccatttttaaaaggtaataaatacatggagttgatggctatagtgacttatttattcttttctctttgctttgaagtcaagaaatatttgtgctccctttttcacatgactcccctctgcccaccctgtttccacatagtctgttattaaaacaagttggaatcacaaaataaaaacctcaacagttgtctctcgactttcaactccatgattaaaaggagactgaaattatagtttagaggagtatccaaagtatgtacacgtgacatagttagttcagatgttgtgcagagtgcagcaaagtgtagctccaaagaagacagaataagtaaatgttaagtaaattagtttaatccaagcagataagaaaaagacatgtacttaatttatattgaagaaacagtcacttggtaggaggggaaaagggggtttagagtataactatagaagattggtttctgggcacggtggctcacgcttgtaatcccagcactttgggaggctgaggtgcatggatcaccttaggtcaggagttcgagaccaacttggtcaacacggtgaaaccttatctctactaaaaatacaaaaattagctgggcatggtggcaggtgcctgtaatcccagctgcttg

SEQ ID NO: 8626 - DNA, 571 bp, Homo sapiens
taggcacacaagactgcccgatgagtgtcaattgccatccttgttaactggacgcctattactaggccaggtccaggcttaggtgtatcccacacgaagccaaaccggtgaccaccgcccacatggagaaagcaagtgattggctgcgggtcttctgtgtgttcctcctcccacaggaagctactttcgcctaaacaaggacacttgccatccctggctgaccatttctgaagacggacttacggctgtacgaagtgaaaggagaacccccgccagggagctgtcacccagcgacactcacttcaccaggtactttgtcaaccgctcacaagggcgttctgtgaacttcccgaaggtgcactgttattcaggtcaaatccgaatatggcacggaggcagcctcgagggaaaaggaatcctacaaatgagtgaggagggaggagcctaatggggaggggacccagaggagtgtgggcaagaggggtcaggcaggtgcaggcagaagagccccctgggacggtgaggtcaggagagggcgcggtcccctgggagggcatggtccctgggtcct

SEQ ID NO: 8627 - DNA, 487 bp, Homo sapiens
tacggctgcgagaagacgacagaagggtacggctgcgagaagacgacagaagggtacggctgcgagaagacgacagaaggggggagagcatcaggaagaatagctaatgggtgacagacttaatacctaggggatgggttgatctgtgcagccaacaaacatgacacacatttacctatgtaacaaacctgcatatcctgcatatgtaccctgggacataaaataaaagttgatggaaaaaaaaataaaagaaattctataatgtttctatggtgtatggttaaggaaggcaagtaagactcaaattacaagaattaaatggaaagaatacaacataaacacccttttatcaagtgagcatctacatattatttgtctagaactatggtatgagcttaaggctggacgtggtggctcacgcctgtaatcccagcactttgggaggccaaggcaggcagatcacctgaggtcaggagttcaggaccag

SEQ ID NO: 8628 - DNA, 565 bp, Homo sapiens
cggctcactgcaagctccgcctcccgggttcacgccattctcccgcctcagcctctcaagtagctgggattacacgcgcctgccaccacgcccggctaattttatttttgtgtttttagtagagatggggtttcaccatgttagccaggatggtctcgatctcctgaccttgtgatccgcccgcctcggcctcccaaagtgctgggattacaggcttgagccactgtacctggcctgtgtgatgtattttagaggcagtgtagtagcatcctattgatgctgatgcattcttagacctttgattctcaggttcttagacctttgattctcaggttcttagacctttgattaaatgcattctaaaacattttaaatagtatgatcaaagtacaaatagacaattaggcatctctgaaagctgcgtttctgtgtattcaaattattggaaaaagaactaaacattcttggacaatttttctgtcgttttaaaatccgtgggatacatccattaccttaactatcctttcatactcagtaataatattacatcctgaatttaactccg

SEQ ID NO: 8629 - DNA, 586 bp, Homo sapiens
gtatctaatttacttcaggcataacatttaaattctgacatatgtgtcaatctaaaattaattctgacatatgtgtcaatctaaaattacagacaaatttgaaatagaaaatagaaaaatgaatagagtgacattagtttgacggaaaaataaaaggtgacctattttcttaacccgacagcaagaaaatttgtcaggaattcctgacaaaaatgcctttatgagagagccaagcatcatgtctcacacctgtaatgacagctatatggtacactgaggttggagaatttcttcaggccaaaatttcaagaccagcttggggtatatagcaagtcctcatctccaaaataagtgcctttaagagagctttaaaggccgagtgtggtggctcacgcctgtaattccagcactttgggaggctgagacaggtgggtcacctgaggtcaggagttcgagaccagcctggccaacatggtgaaacactttccctactaaaaatacaaaaattagccaggcgtggtggcgcatgcctgtaatcccagctactcgggaggctgagacagcagaattgatcgaacccagctgg

SEQ ID NO: 8630 - DNA, 539 bp, Homo sapiens
agacccagcaaaattgctatatgaataaaatatgtatacaaactaatctttttaaaaaacttttcccaaggctgtatatgaatataaaaacccagatttgaattatacatgcaaactgtaaaagcagagacacatgctccctattaagtctgtgttttaaaatatccagttaccaatcaagaaaccccagtagattccaaagaagcatatgtaagaaaccatgacaaggtaaaagattattatctggcaagtagtgcctagaatcaggtctgagggggccagaagggactatgaatcacaaggtgagaaaagataatttgcagcaaattggtaagatatgtgggaggagctaaagtagttgggtctgccgggtgaggtggctcacacctgtaatcccagcactttgggaggccaaggcaggtgggtcacctgcggtcaggagttctagaccagcctgaccaacatgccaaaaccccgtctctactaaaaatacaaaattagccgggcgtggtggtacatgcctgtaatcccagctactc

SEQ ID NO: 8631 - DNA, 653 bp, Homo sapiens
aaaactggacttcctaacacaggcctatgtgccacatcaccaaaggcttccaatgcaggggtccagatggcccactcttcaccatgacgaagcccgaggccatggaagacatcatcaaaccactgcccacgtgtgcccatcaggtctcactccagatgcctcgcacctaaaagcagggatgccactgtgctctggccagagttgatgctgggggagaagagctagtaccagcctaaggagggaggccaaggttctcaggagtgcagtgctctgaggagggctgggtgccaggcaccacctctgcttgtaccttattacctgctttctcacctgcaataagagtggcccatacaccctaaaaggttttcatttcggccgggcgcggtggctcacgcctgtaatcctagcactttgggaggccgaggcgggcggatcacgaggtcaggagatcgagaccatcctgactaacacagtgaaactacgtctctactaaaaatataaaaaattagccaggcgtgttggcagacgcctgtagtcccagctacttgggaggctgaggcaggagaatggcgtgaacccgggaggcagagcttgcagtgagcaagatcgtgccactgcactccagcctgggcaacatagtgagactctgtctc

SEQ ID NO: 8632 - DNA, 558 bp, Homo sapiens
ggctggagggcaatggcgctatctcagctcactgcaacctccacctcctaggttcaagcgattctcctgtctcagcctcccaagtaggtgggatgacaggcacacgccaccacgctctgctaattttgtgtatttttcattgagatggggtttcactgtgttccccaggctgatctggaactcctgagctcaggtgatgcacccgcctcagcctcaaagtgctaggattacaggtgtgagccatcgcacctggcccacttttcttttacaatatggaattgatgaaatggtttcaggttcaggtacgattatgtgaatacctactgatcatgtaattaactaatactctcactgaaaatttaaattcaactggcaatatactataaagaaattcaggccaggcgcagtggctgacacctataatcccagcactttgggagcccaaggcaggaggatcacttatgccaggaactcaagaccaccctgggcaacatggcgagaccccggtttctacaaaaaaacaaaacaacaacaacaacaaaaacactagctgggcat

SEQ ID NO: 8633 - DNA, 572 bp, Homo sapiens
cattataagtaaaactataacataacataaatattaaaaagttaacacactgttcatattttggtttattaccctccagtcatttttctatgcatattgtcactagattgaggtaatactatatagagacttttgggtccatgttttgaatatcatattatgagcatttcctctgccattaaaattcttcatggcagacctgatttttaatgctgcataacattccacttttcctatgatccataatcattttcctattgttctgtttttagggtgtttctcatttggttataaataacttaatgaacattctttcatgtgaatgtttttaccatatttcatgttattcttaatataattttttaaaaatagaattactgaattaaagaatataaaaatgtaaggctcttacttttttgtgctgtaaactcaaaatcgaggtaaactatactaatttaaaatttcacaaatagacatgaaagtccatttgctgcacatcaacagtgaatattaccatccaaaaatattaactatcaggcaagatctgttctaaatggatttaaagcataacg

SEQ ID NO: 8634 - DNA, 412 bp, Homo sapiens
tggagctggttcctctcgtctttatgacccgtgaaaagcgcaccaacacgaagacacgcgtgaaaggaccccatctcctaaccagactgacaagcaagggattttttccactcaccgtcagtgggatggttctaagcaccgaggccaacccatttcacacgattatttcacaaaaagaaactttctgtgggacgtgcctgggcgactgaaaagacagccagcaaaactgagaaccttgttcgcaaatccgtaccctctcccaaggcagcctcagaggcccgagggctgaggatccagacccgaaagccactgtaccttctgtaggatcaggctcaaggactaagggggtaaaaggtgccctttcccttcctaagcagaaaattctgtaacccaaccttatgtgtgatcattt

SEQ ID NO: 8635 - DNA, 594 bp, Homo sapiens
tgttggccagtctggtctcaaactactgacctcaagtgatccgcccacctcagcctcccaaagtgccatgattatacacgtgagccaccacaccaggcctttgtctgattttagacagccactttctcactttgtaagaaacttgtaacagtggcagaaatgtcactgtagctgtgatctgtctgttcactgaacagatttcacctaggataacattctgaggcttttctctgggcacacatttagttgttacaccacattatttagctgttttatgagcttaagaacagtagttacaagcaaggtgaatccgcattgctgcactcaaagctttcagataggtgtgtgccacactaatataaacggttgctgtacacgtacagagaaacttctctagtaacgaactgtagaaatgatccctggaagtacagtcttcctgcctgtgggctttgtctaggtgctgctcttaaatacgtgtcttacaggtaaacaatctgactgtacattaagggcacgtaagtgacctgtaaagagagttttcactctaggccagtgcggtggctcgcacctgtagtcccagcactttgggagggc

SEQ ID NO: 8636 - DNA, 417 bp, Homo sapiens
aaaaatccaggtatcaatcagagatgttgattgacacgtggtgaattcattactaggttactaggaagagaaagtgtgagagtgcagctaggacaagagtctgataggacaagattactggtaaaagtgatagttcctattctcacatacacacacacacacacacacacacacacgtacccacgtgcatacataggtgtacaggtttaatcaaaataaacttctttaagtgataattttgttgtttcaaagagctcatattggagataaaaatgatagctctaactttttttgttgatatatgcttatacttgccttattattagaatactgagtctcagcaaaagcaaaatcaaaaacaaaacaaagagaatattgattccatgttatctttggaagaatcctaagctactgtgt

SEQ ID NO: 8637 - DNA, 538 bp, Homo sapiens
atagtgagaccccatctctacaaaaaattagctgggtgtggtggtgtgcgcctgtagtcctagctactcggggagactgaggcgggaggatcactgaagctcaggaattggaggctgcagtgagctatgactgcaccattgcactccagtgcagcctggtgacagggcaagcaagacgctgtctctaaaaaagaagacaacattcctaccatcatgcttgtctaatttttaaatttttataaagataggatctcactatgttgcctgggttggtcttgaacggctaggctcaagtgatcctctcgcctcagcctcccaaagtggtaggattacagatgagagccattttacctggcccttatctctttcaaatttagttattctcatatctctgccaatgtcttccagatagataaattctatttactgccttacgtttgcttgttatattcttctgtcctcattttccttaccttgtatggtaaattaaaaagaaaaatgagggcttgggcgtggtggctcacgcctgtaatcctag

SEQ ID NO: 8638 - DNA, 602 bp, Homo sapiens
gaggcactaggttcagtgtacagaactgatattaataaacttccttatccagaacttgtgcaatagccgagcatagtggctcacgcctgtaattccaacactttgggaggccacggcaggcagattgcttgagcccaggagttcgagaccagcctgggcaacatggtgaaggcccatctctacagaactacaaaaattagccaggagtggtggtgcacgcctgtggtcccagctactaaggaggctgaggtgggaggatctcttcagtctaggaagtcgaggctgcagtgagccatgattgcaacactgcactccagcctgggcaaaagagtgagaccctgtctccaataaaaaaaaacaaaacaaaaaagagaacctgtgcattttaacattatctccaactatggaattcattcaatcaccaacttttattaaccatcaagcagggagggaagatatgaacagaaatacagtcagggctttacgacagggatacatctgggaaatgcatcattaggcagttttgttgtgtgaacatgatagagtgcactcacagaatcctagatggtacagcctacagcctacaacacaaacaggctacg

SEQ ID NO: 8639 - DNA, 662 bp, Homo sapiens
ggacatggacaccctacaggggccattgaaaaggcagacaaaccagcaaaaagtcaatccttgaaagataaagttgtgctaagattaatagctgctttatatttacgtatgtatgtatgtatgtatgtatgtatgcatgcatgtattttgagtacattccctaacctcagaagtaggtatcagagtaaagagttttggattggccaggcacggtggctcactcctgtaatcccagcactttgggaggccgaggcaggtggatcacttgaggtcaggagttcgagaccagcgtggccaacatggtgaaaccctgtctctaataaaaatacaaaaattagccaggtgtggtggcacgcgcctgtagccccagctactctggcggctgaggcaggagaatcgcttgaacctgggaggtggaggctgcagtgagctgagatcgcaccactgcattccagcctgggcaacaaaagtgaaactccatctcaaataaagcaaaacagttttggattgatagagcagctggagaaataggggaaccttcagggtgggtatatccaaaaatctcagtataagctctccagttccttggctgactgctaagctccatgggcacaaaaggagaccaggctagaaaagcagcaactggaagttataaaaactga

SEQ ID NO: 8640 - DNA, 520 bp, Homo sapiens
aactgtgctggactcacctgaaagcatggcatcttcaacctaaagtacagcggaaatttgtctcaatgagataaatattctgctactgtatataatagacagctagtaagtataacttttttttctttgagacggagtcttgctctgtcacccaggctggaatgcagtggcataataatctcagcttactgcaacctctgccctcttggttcaacctattctcctgcctcagcctcccgagtagctgagactacagttgggtaccacctggccaggctgatttttgtatttttagtagagatagggtttcatcatgttgtccagtctggtcttgaactcctgacctcaagcaatccgcccaccttagcctcccaaagtgctggaaatacagaagtgagccaccgcgcctggcctaataagtatagatagtatttcacttttatattcctagagcccagcaaaatgcttggtaatttgtaggtgaagaaaaatgtttaacttaatagaaatctaaaatttt

SEQ ID NO: 8641 - DNA, 480 bp, Homo sapiens
acagttggagaatatttgtcagaaatggggaggttgttgtaattgagttgccagaattacagagtttccattttcagatatcacagttgaatcacctctgtagattgttataaagagaggcattttaagatagtattttatttgctaggttgtgtctcagtctaagaattgggaaaagaagagctataggtttctctttcctagtctggatttcagtaaacacaagcctacctctgcttctttggttcacagcagtgtggatcatgaaatgaactgtttacccacattcatcaatattggtattttacaaatctacttggagcatttaatttcatctcaaagattgtgatccactttagataagcacaaatacagtattaggaaaagtaaatatgcaatcttactaaaatttcaacttgttaagctgtatatcttaaaagaaattatttggggctgggcatggtggctcacacctgtaat

SEQ ID NO: 8642 - DNA, 629 bp, Homo sapiens
  misc_feature 519: n = A,T,C or G
tgttcataaattgataaaataaaaacatatattttataaatatatttcagactgttttaataaacataattaaaagatatcccagctgaagtaagctgtatatctaattagtaatacatacaaatcccttgtagacaagttttctattctccagctgtctgtgagattagaatgtgtgcagatagctgaagaatgaatagtgctttttgtgtttcttaggcattacagacgagaaggatttactcgactttgaattcattatatcattactatttcctccagttttataatgtcaattccaaattattcaaaggtttgtgaaattgctgttctttgagcattgaaaatatgaactaagactaacattaatccattgttcaatcttaatgcctttaacaaagatcggtctcttgtaaaatgtaaaaaaattaagtctgagtctgtaggtaagattgaggccacttagtccagtatattttaactttagcattctctttcttcagagctctgccaacattntatttgatttttactttaaaatgcatctcggccgggcgcggtggctcacgcctgtaatcccagcactttgggaggccgaggcgggcggatcacgaggtcaggagatcgag

SEQ ID NO: 8643 - DNA, 252 bp, Homo sapiens
gagtgagaacatgcagtgtttggttttctgttcctgtgttagtttgctgtgatgatggtttccattacatattaattataaaattcatctggaaaagtaaaaagaagattttataaaatttttgaaaaagattcagggttccatcaggacacagaaacaaaacaataatttaaacaatgaaagtttaatattaagaattattaggccagacacagtggcttctgcctgtaatctcagtactttgggaggctg

SEQ ID NO: 8644 - DNA, 548 bp, Homo sapiens
atctaaagtagcacctgcacccactccaactttgtatcacctcatctggctttacttttcttcacagcacttattcctacccaacattatattcttgtctgcaatttttttgtatttttattatctgtcttccctactggtgtataagctggatgacagcagtgattttgtctatttagttctctctagaacaatgctatctagaataagtgttcaataaatatttaacataaaatttatgtttcacttttagaaacctcaaactatagatttcaaaagtagtaaccattcctaaagtatctaatttgattagtcttaatttaaaaaaattgtttgggccaggcacagtggctgacgactgtaatcccagcactttgggaggctgaggcaggcggatcacaaggtcaggagtttgagaccagcctagccaacatggtaaaaccccatctctactaaaaatacaaaaataaataagccaggcatggtggtgtgcacctgtaatcccagctactcaggaggctgaggcaggaaaattgcttgaatctgga

SEQ ID NO: 8645 - DNA, 581 bp, Homo sapiens
tggagtaaaagcaagggcacccaagacggcagggaattaaaaggaagaactcttaattagaaaatagaaaatgcctcctgggtggtgttagtaataggtaaatttaagctgagatgaggttagagaggacagaaatggaacagatgaaaccacataagacagaaaagtagtggggcatgttgcagcaaattgactccacatgggctgtgtacagaggaggaaactaggttggggccagatcctggacacccttgaattacagcatgagaaagaaagttgtaccttaattcagactgcctgggaggcttatcagggggtggaatggtagggattgggagggagggcgtgcaagggcatctattgaacagagtgggaagattgaagtggtgctgatatataaactggattcgaatgaggggaggctgggagtagatggatccaggcaattatgttaataacagtctaggaccgtggtctttaaactttattactgcatacctactaaaataattttgaaaactctgtatcatgtattttaaagttgacattcaaaattttctccataaaatttccatatttgc

SEQ ID NO: 8646 - DNA, 573 bp, Homo sapiens
agcctaaactaaggtagtggcaatgggtgtagaaaggaggtaagaaattcaaagagtgctatggaatatatacatattaatgttgctgatcactttttttgtacgctctggggatgtgacaaatatgggttagggggatctcagtctgtactttgatttaggcaactgaatatacataaccttagtagtaccattcactgagttttgttttgtgctctttttgggaggagatggggaagaaaaataatccatatgaagatatgttgcgtttcaatgcctatgagatactaagaagtaggtattcagtagaaagttgaaaacttgggtctgctacttagaaataaggcctgttttaaactagatatgtgtcagatgatttagagaaacacaaggaaaaagtcaagaaaagatagcatcaaaatttaaggcagcagttgggacacaaagggagataaagtgaataggcttataaggaactgtcagaaggaggaaaaaacaagataacgtggaacaacaggatgaaaatagaagacacacgtatagtgattattatgtggcaggcactattctaaa

SEQ ID NO: 8647 - DNA, 494 bp, Homo sapiens
ttctcaaataaacattcagttttttctgttattgggggaaaacctttaaaattgtatctcacataacaaaattaaaatttatttgcctgattcaataattacttcatgaaatgcattcaataaaatcatcttatacactgaaaaaagaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgaggcaagatcgcgccactgcactccagcctgggcaacagagtgagactctgttaca

SEQ ID NO: 8648 - DNA, 620 bp, Homo sapiens
tgtattctaagaaaggcaatcactgattttgttaaaatttaaatacatttttgaagcaaacagaaattaataagtaaaaaagcttaaataatatgaaaaacttttgaaatttaagaactgaaatatactgaactttgtaaaatattcaggaaataaggacatttatatcattatgggctttgtagacataatgaaaatgagaatactacatgtgaaatttaaggtcagagtcaaaaccttaccattccactctgcccaaattctactaaagagaaaataatatctttaaatgtttcattactacaaaagatagtaaatatattaataagcattttattctagttggaaaaaatgtataccttaaatgcctccccaaatagattaaataagtataacaactaaaaatgataaattagaaaataaaaagatcagatatgatcatcaaataaaattttgaaaatagattaccaaaggggtaaacttttaacaaatctaaccaagaaaaatgaagagaaaaagtaataaacagagtgaaataaaattagaaagactcttccacaagggaatttttaaagtgtatcagaaaaaataaaaaataaaatttctcacaattagctcaa

SEQ ID NO: 8649 - DNA, 522 bp, Homo sapiens
cacatgtaccctaaaacttaaagtataataataataaaattaaaaaaaaaggaaaaaaaagaggcaactgtttctaagagttttgaaaagtgtgtattcatcaatctacactaattctggagatcccttcgcacaggtttcactaaaacaaaaactataactgcaatataaaagctgctacaggtaacagtgctctcccaagttatttaggtaaaggctttataagctttagttattctttctatagaaaagaactgttcactttattataacaacagtcaaagtgatttacatgtccatgacaacttaaggttatcatttaaaaatgccttttacttatgttatcactcacgcagtgcattcttctcaaaaatggaagacatggccaggcatggtggctcactcctgtaatcccagcacgttgggaggcctaggtgggtggatcacctgaggtcaggagtttgagaccagcctggccaacattgtgaaacccagtctctactcaaaatacaaaaaaaattt

SEQ ID NO: 8650 - DNA, 184 bp, Homo sapiens
ggagcctgatcacagctatatctttaatgtgtggagtgatatttctaattgggcatgcacatcggactcttttacatttatactgcatatatattattaggtcctgactggctacttgtcacgttgttttggcgagcattatttactattctatctgtgggaacacactacccagcatgtctga

SEQ ID NO: 8651 - DNA, 413 bp, Homo sapiens
gattcacgtctccttccaaaatggaaggatattcggaggctcggtattgccaagtgagggaagatttggaggtggtttactttgctggggctgccataacaaagtacgcgagactgggtagctcaaacaccaaggttggtttctcctgaagcctctctccttggcttgtagatgacatcttctccccatgtccccatgtggtcttccccctgtgattctgtgtcctaatcccctacttgtaaggacaccagtcatactggctgaggacccacccaccctaattgtctccctttaacttaattatctctgtagaaaacctgaggtcctgggggttaggacttctacttttgaatttgggaggggcacaacatagcccataacagagagcatcttcagagtccgtgctcctgcag

SEQ ID NO: 8652 - DNA, 392 bp, Homo sapiens
ggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccaacctgtccaggatacagtggggctgagcacccccaggccttccactcctctaccctctgggcaccaaaaggctcct

SEQ ID NO: 8653 - DNA, 107 bp, Homo sapiens
ctgaggtaggagaatcgcttgaacctacatccttgtagcctatgacggatttccttaagctgaataatattccattgtatatatgatggatgatcttgctacatcat

SEQ ID NO: 8654 - DNA, 339 bp, Homo sapiens
actggtatgctacttcctccagaaaaacacccttaatatccgttttggcctcttttaaaattcctcttctccatgttcctgtagtactccagtttacctgtgtctgacactgaagacgctgtgctttactgtacatttgggagtctcccctcccactggagactgggctccctaagggcgggtctgtcctgagtatctctgtggtgtcccctctggtgcagtgtctagcattggtcaacagatgttcatggcaccgaactgataaattgatgtgtgtgtacgtgtcacgtgttcctggcaaaggattaagttgctagccaggcacagtgcctcacgcct

SEQ ID NO: 8655 - DNA, 482 bp, Homo sapiens
cagcaatatgtacttttgtttgtttatttgagacagagtcttgctctgtccccaggctggagtgcagtggcacaatctcggctcactgcaacctctaccttctgggttcaaacaattcttctgcctgcctcctaagtagctgggactgcaggtgcatgcaagcatgccagctaatttttgtatttttagtagaggtggggtttaaccatgttgcccaggctgatctggaactcctgagctcaggtgatctgcccacctcagcctcccaaagtgctgggattataggcgtgagccactgtgcctggccagcatatctacttttgaagttcagccccaggctgcagacctggctgggtccaggcttcaaatgatgtcaccagggccaggctctcttcgtccctctggctggcttcatgggtgggagcggccaccaggagggctaggctgccttctttccaagtttaaaagtgaactcaaaagct

SEQ ID NO: 8656 - DNA, 56 bp, Homo sapiens
gcagcttccgggaaaccaaagtctttgggttccggggggagtatggttgcaaagcc

SEQ ID NO: 8657 - DNA, 581 bp, Homo sapiens
agccatggccgctgggtgggctccaggggaggggagctcctctgaaccaaccatcctgtccccactatacacacatgcacacagggggctgttcaagactgaccgggtgctggggacagcccagctgaagctggatgcactggagatagcatgtgaggtccgggagatccttgaggtgagaggtggacattcatccgcgtgctccggtatggccatgctactcgttaacattattaaaacacttcctgccttgagccctctatgagcctgtctgttgacccagcccctcccctcagagcctcagacctccctactgcccagccctaaatacttgcagtaccccactccattatgatcaactggtatctcagccataccatgggctcatattttagaaaccactcttggccaggcatggtggctcatgcctgtaatcccagcactttgggaggctgaggcgggcagatcacgaggtcaggagatcgagaccatcctggctaacatggtgaaaccctgtttctactaaaatacaaaaaaattagccaggcatggtggcgggcgcctgtagtcccagctactcg

SEQ ID NO: 8658 - DNA, 448 bp, Homo sapiens
caaatatcctcagtaaagtactggcaaacaaaattcaacagcacattaaaagatttatatgccgtgatcaagagaaatttatccctgggttacaacagtggttcagcatatataaatcagttaatgtgatatatcacattcacagattaaaagcaaaaaacacatatatacctcaatagatacagaaaaatattttttaaactcaacatccattaatgataaataatatttaacaaaataggtataaaaaacttacctcaatactaacataataattaatagacaaagaagcctgaaaactttttctcaaggacccagtagaaaacaaggatttcggccgggcacggtggctcacacctgtaaccccagcactttgggaggccgaggtgggtggatcacgaggtcaggagatggagaccatcctggctaacatggtgaaaccccatct

SEQ ID NO: 8659 - DNA, 588 bp, Homo sapiens
atcccttgagcccaggggttcaagactagcctgggcaacaaaacaagactccgtctctacaaaaaaaattttttttaatttaaaaattagctgggcatggtggtgcatgtctgtggtcccagctacctgggaggctaaagcaggagaatcacctgagcccaggagttcaaggctgcactgagccatgattatgccactgtactccagcctgggtagcagagtgagacactgtctcaaaaaagaaaacaaaagaaggaaaggaaagagaaaggagaagggaagggaaaatggaaggagagagaaaagaagggcagggcagggaaggggaaagaagggcagggcagggcagggcccagccagggtagatagtagtattgtgacttagagcatacaaccattatccaggcctcagggtacatttataacagtaacagtcaatctaatactgtatatggtattagttacccaggagcctgacatcaagtcagcagtcctccaactggtgggacaggcagacttgcagagagcactatgaaggacagcaggctccaattcaatagaatagaccaaaagagaacagtaagggag

SEQ ID NO: 8660 - DNA, 603 bp, Homo sapiens
tacatataaaatgcctcacaaatcttgggttaagaacttctcctctaaaaagagtaggaagtcgaaattgaaaacaggagcctatttactcaatcatttggcttgaagttgaggcaaatgccttatatataggattgtcgctgaggtctccatcttcccaagcaaaggtgccctctgcactcttcttgccaaccaaaccaaaccaaaccaaacaaaaacaaaaaactcaagaaacaagcacaagcactccaattcttgtgcccacatcacagtacattcaaccttaacaccttagaggtttacttatccttatccttaaatgttttctttcttgtaggccactaaggttgggtatgcttctagtaatgggaatacatggggctgagcctctacttgcctgcctcagagcacatattggaaatttcctagtaccaaaatctgatccctagtttaggaagaagtcaagagaccatgttggaagataaaaataaacgtatataaaccagaacaagattggaggggagaggaggcaactgggagacagaacaacttgtgaagagacaaatacattacagaaattcataaagtgtgaaagtaatacat

SEQ ID NO: 8661 - DNA, 381 bp, Homo sapiens
tctattctttttcatgtttccatgttcctttctctttttcttgaaagattagacctagaatctatcataaccaactaatgcatactctatataaatttgttgatcaaataaaatgttagagctatttaaatttatcataacagctttattaaaaaacttttactgggcttagttcaagaaccagctttgctctaacaatcctggggccccatgttatttagttgccacatggcctcacattcaaagaaatacaatctaaaagctaaaagtaattttaacaggaattctgttctttcagcatctctgaaatagcttataagcgatttatttttcaactcacatcaatatttatcaaagtactctttttttttaaataaaaag

SEQ ID NO: 8662 - DNA, 445 bp, Homo sapiens
aattcggcacgaggcttcctgctctttgtattttggctaaaggcggtgaagtgagaggcggagggggatttaaaaccagcagaaaaaggcttcttgttgggctgatggtgtttgtgcgagaagctgaggtgggcagggaggagagcctaggagagcggtagggctcatgggcaggccgttggtgtacgccttggccctgcctgtccccagtcccaccactgtggactccaggccatcctcagtccaggtggtcactgtggcctgggccacatgctggcgatgacggggatggccttccacatgcctgttctctggaagaggggctcgcgttgtgcccaactggggacgtcctgcccccaaccccccaaaacgctgctttcttctgccctcaagaggccctcagaagagaggaggctgagtgaggggcatgagataaaccccgaaa

SEQ ID NO: 8663 - DNA, 179 bp, Homo sapiens
atgaagtcagagctaagaaatgctagtggggatagggggtgagatagagttgggaaatgtttcagagctacaggtgacagttgttggtgtccagttggatatgtaccatgaagggaagaagcagtcagagtgggcaccaagctttctagcctggaggactgaatggttctgtgcacatt

SEQ ID NO: 8664 - DNA, 490 bp, Homo sapiens
ggcacgaggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaa

SEQ ID NO: 8665 - DNA, 166 bp, Homo sapiens
cgagccacaagctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggc

SEQ ID NO: 8666 - DNA, 445 bp, Homo sapiens
ggcacgaggcatatgcttgtctcaaagattaagccatgcatgtctaagtacgcagggcctgagtctctgccctcgtgggcgttgagtgacactgattctcgcgtgtctccggcctctccggcagggagtcctagcgcagactttgcggatcatggagagtctctgggagacaggcacctgcggacgctgcagataagttacgacgcactgaaagatgaaaattctaagctgagaagaaagctgaatgaggttcagagcttatctgaagctcaaacagaaatggtgaggacgcttgagcggaagttataagcaaaaatgatcaaggaggaaagcgactaccacgacctggagtcggtggttcagcacgtggagcagaacctggagctgatgaccaaacgggctgtaaaggcagaaaaccacgtcgtgaaactaaaacaggaaatca

SEQ ID NO: 8667 - DNA, 228 bp, Homo sapiens
acagaataagactccatctcaagaaaaaaaaaggttaaagttcctgacttaatgaggaaataaaaaaattatatgctgaagttgctaaaatctagcttgtgtttgtgaaattgtgaagaaagaaaaagaaattcatagtagttttatggtcacacttctgcaaaaattgcagccacagtgcatgataagtgcatagttaaaatggaaaaggcattttttgagtggaaa

SEQ ID NO: 8668 - DNA, 141 bp, Homo sapiens
ggcacgaggttttttttttttttttttcaagccccagccccctttttttttatttaaaaaacccaaaccaccccccgggccccaaaaaaggaaacctggttggggccgtgaaaaaggggccaccagggggcccgggggggg

SEQ ID NO: 8669 - DNA, 544 bp, Homo sapiens
ggcacgagcctagttatgctataatcaagcaggaaatgtttatggaatggaaagattaaggaaaaggtatgttcttattttagcaataaaacgaataccagaagctttaacattcaccagtacaaataaatagtttcaatggaataggtcgaaagtaaagggacatcactagagtaaatgctagaccttccctctccttttatttttagcaacagcaaagcagaaactaagatctacaagtgatcaaagagggtgatccattcagtttctgtgtagacaggaataataataataccttttacatattggtacagtttgtaaaaacactttcacttactcatttaatcttcatagcaacttgatgaggtagaatactataggaagcagtattagctcaggttggtacgtaaattactgtgtttaaatttcaataaaacagctatggaatccaagacattcttggcgcctaataaactgtattctttgccaacagtgaaagtgcttctctgttgcttggtaagttttttccccttagaatactaat

SEQ ID NO: 8670 - DNA, 300 bp, Homo sapiens
ctatgatcaggactgactaggtagttggcatggcccatagagaacaaggaaagatgggctggtggattggcccacctgggagccacatggggcaaggggagccctcaccctcagccagccagacgagtgggatttcccccagcacagcatacccccttcacaaagggacaactaaagtgcttcattaagcaagtcctggatcctgtgccccccaactgggtgagacaccccaatgggtcaccagacaccttatacaagagcatttctactggcatcaggtgggtgcccctcaaggacaga

SEQ ID NO: 8671 - DNA, 393 bp, Homo sapiens
gggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggttacctccctcgccccaaggttccagaggccctaggcgggatgggctcgctgaacct

SEQ ID NO: 8672 - DNA, 476 bp, Homo sapiens
ggcacgagctcatcacactgttgtatacttcgtagctattacttctttaatccccaaggacttgtttaacaaagtgttcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggtttgttacatggctagattatgtaatgccgaggtttggcctgctagcgcagccatcatccaaagtgaccctagtacccaataggtagttttcaacctgtgtgcctcctcttctaccttctcttttggaatctctagtctattacttccatctttatgttcacatgtactca

SEQ ID NO: 8673 - DNA, 181 bp, Homo sapiens
ggcacgagctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgt

SEQ ID NO: 8674 - DNA, 300 bp, Homo sapiens
tctgtcaagtgtcctcatggtattctctctgttcctctcctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaa

SEQ ID NO: 8675 - DNA, 62 bp, Homo sapiens
ggcacgagggggcttcttagggccaatcttaccacaatgctcacgtggacacgcaggggctt

SEQ ID NO: 8676 - DNA, 300 bp, Homo sapiens
ccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaag

SEQ ID NO: 8677 - DNA, 174 bp, Homo sapiens
cccaagccaagcatcgcatcccctgtgatttgcacgtatacatccagatggcctaaagtaactgaagatccacaaaagaagtaaaaatagccttaactgatgacattccaccactgtgatttgttcctgccccaccctaactgatcaatgtactttgtaatctcccccaccctt

SEQ ID NO: 8678 - DNA, 489 bp, Homo sapiens
acacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagctgctgatgattcctctgatcatgtcagtactttatgtct

SEQ ID NO: 8679 - DNA, 669 bp, Homo sapiens
ggcacttgagataagcctcataggaggagagaagcttctccctgtgtggaaggaggcagcacacaggccacagagaggcgcagaagggacaactgaggccaagagaggcggaaggtccccagacgggttttctaaaatatctttctctgaatagcatttttacttaaatttgatatgcaaatgcagataattggtattcatgtaaatatttactgcttaaaacagaaagttacttgtaataggccaggcacagtggctcacgcctgtaatcccagcactttgggaggctgaggcaggcagatcacgaggtcaaaagatcgagaccatcctggccaacatggtgaaaccttgtctctactaaaaatacaacaattagctgcctcaggaggctgaggcaggagaatcacttgaaccagggaggcagaggttgcagtgagccgagatcgcaccactgcactccagcctggtgacagagcaagactccatctcgaaaaaagagaaagttacttataatagaaagcctgttcaaatgtggcaagtgcaacgtattcttttggaggctctaaacccaagcctgcaggtccctgatacgtcttctttgccatctagtggtagccattagaactgcatgtgtgggcccggcgccgtggctcacgcctgtaattcccg

SEQ ID NO: 8680 - DNA, 197 bp, Homo sapiens
tgggacccttcacggatgacatctgccaacgctgtggggactctcatcaaaactgctccttcctttccacgggtctgcttcttctgacctcatcttatgtttgctttttcttttcttccttggctatttttctacgatcctctaataaccaagtccttgcaacttttggctcatatgggatacacagacaacttttt

SEQ ID NO: 8681 - DNA, 153 bp, Homo sapiens
gttgttagatgtcagctaaaataaagactatttgaaacatgtacagatatgcagcaaatatcacacttgatgttgtaggactaaaagcttttcctttgggatccagaataagtcaaggctgcttgctgtcactactctgttcagcactgtatt

SEQ ID NO: 8682 - DNA, 461 bp, Homo sapiens
atgtgagtgtgtgtgtgtgtatagcatcaagtatagccacaaggtagtagccttagtcactaaattgtttgctattgctggctgtattcatcacgggagtccatgttgactcagatatgtaggacagcaagaattcccacgtcttctgagctcaccttacagagctaagagatatggcagccttaatgaaaggggggagcctttactcacataaaccctgtgaattctactgtaaattttcctacatccaaatggaatgtattttggatgttgaggattgttgagggggcggggtctgtttttaaacaagtgagaaattgatatatatttacacgctatcatattgtacagaaactggccattgatcagtagaaatctcaccaaatacagagaaagtcttgattcaaaacttaaaatagcagggagaccaatgtttaaaacatgttgagttaaaaaagaaa

SEQ ID NO: 8683 - DNA, 348 bp, Homo sapiens
gccccttcggattctttctataagcaaattgcgccttggacataggctttgaatgctttgagagaacctctcttcataagtggaaataaaatcatgatttaattgtatcaaacgcattatggataatctatgggatttaatgaatcaataggtgaggctgagttggtaagaagtgaacgttacttctgcatttaaaaaaatacatttaactcaataggaagtaacagatgagtaattggaaaacattttaaacttgatcataaagaaataaaaattggccatgtgcagtggctcatgtctgtaatcccagcactttgggaggtaaggcgggcagatcatttgagttta

SEQ ID NO: 8684 - DNA, 331 bp, Homo sapiens
ggctagattttcagatgtgggattatgggttcagatatggtttacacatttttatagttcttaatacagatggccaaattgctttctgaaagagaagcttttcttaagtatttttctccaacttgtatcttaaacatcctgaacatgcttagcaccactgtcttgatatatctgcggaaagccacgtctccacttttcagtgtgtcgggccctgggagaggcaggcatcctgcgctggctccttggagctgggtttaaaaatgtctcctctggctgggcgcggtggctcacacctgtaatcccagtacttttgggaggccgaggtgggcgg

SEQ ID NO: 8685 - DNA, 130 bp, Homo sapiens
tgaaggtttaaatccaaggtcatggcaaaacatctgaagttcatcgccaggactgtgatggtacaggaagggaacgtggaaagcgcatacaggaccctaaacagaatcctcactatggatgggctcattg

SEQ ID NO: 8686 - DNA, 529 bp, Homo sapiens
ccgttgctgtcgctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctg

SEQ ID NO: 8687 - DNA, 366 bp, Homo sapiens
taagtgaccatttcttcactcctggttttccaattgttttgacactgacattcaattaggaggactaaatacacagtggtgatgatggtggtgattatatcattttatgatcaacaccttcttcactgtttgcttctcccaatattacttatgagacaggaacttactttttcttatggccctcaacaccccccagttgctcctagaaccctatctcttttctgatcccattacacaattttgaggttttcgttcccccccttatactttgttttcctgcgatttttgagggacctggggttttttctacctctcctttttctcttaaattttttctttctaacttagacctcccttccctttttg

SEQ ID NO: 8688 - DNA, 91 bp, Homo sapiens
tgctgtcggaagctagatggactaggagagacttgattttggtgctaaagttccccagttcatatgtgacatctttttaaaaaaaataaca

SEQ ID NO: 8689 - DNA, 380 bp, Homo sapiens
aaggacaaggtttgggcatggcagcagagctgaatgaaagcttgccatcatggtgtactggaaaggtacagatacatggtgaatgccactgttctggactttgtgttcattggtaataaatgaaggagctcaacttgtttttgcaagagggacatttgcaataattaatctagggacagagagatactgtaaagatcaatgattaggatttgggatccggcctcagataaaccagggctcaaaactctcttcttcctcttaataagtgagtgagtgagtgacttttggaagtcacctccctaaataccagttcttcatctattaatgggcatgttaacagtacagtcctgaagggctaatggaaagaaaatacatttaaa

SEQ ID NO: 8690 - DNA, 360 bp, Homo sapiens
agaagttgagtggttgggacagtggtccccttcgtggtggaaagaacactgcctcagataatgtgtggctttcctctggtcagaggcccaaatgagtggacaagtactgtgatttctcaagcccctatgcagtgttagatgccactatgaaatacgagccattgaaagaaatctcttcaacttattattttttatcacgaacgtacatatcagttatttatgagatttttttttttaaatatttcattttttttcacgactttttctgccattgaattaccctttttctcatgcactgggggtcaaaaaatacatgccataataagatggcagttaaacttcatcagtattttttttttt

SEQ ID NO: 8691 - DNA, 209 bp, Homo sapiens
tgatgccaatatatttgcgacttcccacttgcaatatcattatcaacaggtagagaaagacataatggtttcaatctccttgctgacaaacacttctctacacttgttaaatcacagatttagctaaaaaaaaatgaaaggaatattccccgttggctgtgaatttataaaaattgctttctttggcagacagtcctgtttcctgtctc

SEQ ID NO: 8692 - DNA, 315 bp, Homo sapiens
  misc_feature 41, 48, 50, 51, 52, 55, 69: n = A,T,C or G
ggcacccaccaccacacctgactaatttttgtatttttagnagagacngnnnttnaccattttggccangctgggctggaactcctgacctcacgggagccacctgcctcaatctcccaaggcgctgacactccccgcgccacccactgcgccccgcggaccacccctcctcactgggagcgcgcccacccggggggccgccaccacctttcgccccccacccccacggaatggggagtaaagcgggcccccccgcccccccaccccgcgaattatcctggagctcacagagcgcacccgcccgccccccccccc

SEQ ID NO: 8693 - DNA, 390 bp, Homo sapiens
ggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaag

SEQ ID NO: 8694 - DNA, 470 bp, Homo sapiens
attttctttactcctgtatctgatgtctgggctgcgatgactcaaaggctgatttcagctgagactgtagaccacgtgcctacttgtggcctccccttttgccttgggtttctcacagaatgtggctggttctggagaatgagacttccaatgaaatcaggtggaaatgacatctcgccgctttcagcatgctctattggttggaacagttatggacttagctagattcaaaggaagggaacaaagaccccctcctctcagagagtggggcataatgagagaatttagggccatgttatccaaccaccacaaatgccttctgaatttgaggttctgcctcaaaagttcatagttcctttgactgaaggacttctatatatccaagcatcgtcagccccaggtatattgttccatgtaagtgaccaggactaccttagtatttcgtatagggaaagtgacctgaataaatt

SEQ ID NO: 8695 - DNA, 79 bp, Homo sapiens
cgattctcctgcctcagcctcccaagtagctgggactatttttgtatttttgtatttttctaattttgtatttttagta

SEQ ID NO: 8696 - DNA, 357 bp, Homo sapiens
ggaaaggaggtagaaggatgagaccctaacacctggtttctccttccacttcaggcatttgtcagattcttggactgcattgagtaggggaataagaagttgggcagaaatcccctaacatatgtcctggtttctcagggctaaagaggaaaacactgaatttcaaggcccaaccaagtcaagggcccccttagtaaatacactacactttgggctgggtgacctcaaggtccacacctaaggtaacatcaaggcgatccagaagtagatcttaaatgtagctcaatcttggctgggcatggcggttcacgcctgtaatctcagcactttgggaagccgaggcgtgtggatcccttg

SEQ ID NO: 8697 - DNA, 202 bp, Homo sapiens
acagaagggggcccactgaaagttattacaaaaaattgtgcagagtaaatcaactaatcccagtgaatcaactaatccaaggctgtgatcattttaataactctccacaaaggctcagaaaatttctccacccatgaatttcttctacacagctgtgattataatgtgatacaaaagcaacatccttcagctagtgcagttg

SEQ ID NO: 8698 - DNA, 654 bp, Homo sapiens
ttagtagagacgggatttcacttgttagccaggatggttttgatctcctgacctcgtgacccacccgtctcagcctcccaaagtgctgggattacaggtgtgagccgccatagccagcccatacatctctctttaaagaaactccttagactcctgtgggcaatctggaaggcttagagaagattgtttctgtgaagctgaaggtagattccatgcaggaactctgtgaatttatagaaatcatgtaaaacctgattttccccaccccctatcatccccaaatgtgccaatggacagacccagcctcaagattccaggttttcagtctctttgatcacttgctcctaaatgaaatccagcaagagagaggaagaattttacttgctgttctgacatttcaccatcttcctcagatttagtttgctctgctatgcgggagtcaacagaaaatggcacacaaatatccatcgactctttctaaaatatgttaaagttgatgtgtacaatagctcccaggtcacacagtctattaatacaccacacagatctgaaaatatgcccatgaacctacagtttcagatagagaaacaccagcctagagtcttactactgagcatttttaaggctacacatggtcattgctgaaagagagag

SEQ ID NO: 8699 - DNA, 91 bp, Homo sapiens
gagctaaaacaaaatcaccaaaaaaatctcataatgttttaagaaaagtttatgaatttgtgttgggctacgggttgtacaagcttgcttt

SEQ ID NO: 8700 - DNA, 255 bp, Homo sapiens
gggatcgcgtctgcaactcttattgctttggcgtttacctattggggatttaaaaaaaaaattgttcatttttataaaaaagacatgggctggctgggcacggtggctcaggcctgtaatcccaatactttgggaggctgaggtgggcggatcacctgaggtaaggatttcgagaccagcctgatcaacatggagaaaccctgtctctaccaaaaatacaaagttagccaggcgtggtggctcatgccagtaatc

SEQ ID NO: 8701 - DNA, 620 bp, Homo sapiens
atctttcattacatattcttccgtagtcatatgttcataaagggtagagtgcatgcacaaaacacctgcacttttaaaattctttctctcctcttttgttaagtatatttatttgaacttgcttaagttaaatacatgcatgagacaatatcaacatatgctaaaattatttatcacagctaaagacatctcaccgaattccactcatctgatttaactgtttatgctatcttaaagtttcctgtatttctcgttctgttactttgctaatttcgtatactcaaccctgatttggaacatagacatctacctttaaaattcaattaagatttttggtaacttcttaagtttttttaactgtggtaaaatatacataaaatgtaaccatgaccacgtgcggtggctcacgcctatagtcccagcactttgggaggctgaggcaggaagatcacttgaggtcaggagtttgagaccagcctggccaacatggtgaaaccccatctctgctaaaaatacaaaaattagctgggcgtggtggtgggtgcctataatcccagctactcaggaggctaaggcaggagaactgcttgaatctgggaggcggaggctgcagtgagctg

SEQ ID NO: 8702 - DNA, 501 bp, Homo sapiens
attttaacatggaggaccgatccatatattgaaatccaattcttctactctttaaactcagctcaagcttcattccttctattaagtctgtaacccaaatgaatcagaccttttgctgcatcctcattgtacctgtgtgcacagaccacaactgcaccacctatatactacatacttgaggcatacatttatcatcactcctctgggtttcttccttatgagactgtaataatgtaggggaaaggcagacctggcccctgtctttatacccccagaacctagcacagaggctggtaggagtaaatgataagaaaattatactcaaggacgggtgcggtggctcatgcctataaacctaggactttgggaggccgaggtgggcagatcacctgaggtcgggagttccagaccagactgaccaacatggagaaagcccatctctactaaaaatacaaaattagccaggcatgggtggtgcacgcctgtaatcccagctactcg

SEQ ID NO: 8703 - DNA, 459 bp, Homo sapiens
aatattttgttaaaaatgcccccacatttattattgaagtatattcaaaatatattcaagatttgatacattggtttagccattcagctgatgttgagattgcagcaacctcagcccacaaaaacacaaacctgaggtggagtgtattcatccatttttgtactgctttgaagaaatacctgagactgggtaatttataaagaaaaagaggtttaagggactcgcagttccacatggctgggaggcgagggaggagcaagggcacatcttacatggctgaaggcaagagagtgtgtgtaggggaacggccctttataaaaccatcagatctcatgagacttattcactatcactagaacagcgccaaaaaacctgcccccgtgattcagttaccttccatcaggtacctcccatgacacatgggaattatgggagctacagttaagatgagatttggct

SEQ ID NO: 8704 - DNA, 311 bp, Homo sapiens
tccagagtttggcccactcttcccctggggaaaactgtcattgtcttggctgggcatggtggctcatgcctgtaatcctaccactttgggagttcaaggtatgtggatcactttaggtcacgattttgagaccagcctggccaacatggtgaaacctcatctcactaaaaatacaaaaattatcctggcgtggtggcacatacctgcaatcccagctactcaagaggctgaggcaggataatcacttgaacccaggaggcacatgctgcagtgagccaagattgcaccactgcactccagtctgggcgaca

SEQ ID NO: 8705 - DNA, 271 bp, Homo sapiens
caagggtacagtgaactaaagatcatgccagccactgaactccagcctgggcaacagagcaagaccctgttttagggggaaaaaaaaatctatcttagctcctatgtgccataaatgttacaacactcatagtctggaggaatcacaaagtctttaagaaaatggagacaggacctatagtgatcactactcacaaatcactagaatcacatgctgaaacactgctgcagaatatcaatgtgtggtctgttcccactggccattaacccaa

SEQ ID NO: 8706 - DNA, 118 bp, Homo sapiens
atggactgtgccagtcttgtccactcctgtgtccccaggtcctgtcacaaggcctggcatgtggtagatttaaagtggttgcaagaagccgggcgcggtggctcacgcctgtaatccc

SEQ ID NO: 8707 - DNA, 469 bp, Homo sapiens
caatggtgagataccagcccctagaggagaagactccaaagtgcctctgtccctcacccatcaggtgccctgaacaagattaaagctattgcccggaagaccaaagaggtgattgaccgggtccgcaagttctttcggtcaatcatggatggtgtgaaacacataggtaagcacattagcatgtctatcccggggactcaaaatgcacccagtcctggccgggtgcggtggctcatgcctgtaatcccagcactttgcgaggccgaggtgggagaatcacttgagcccaggagtttgagaccagccttggcaacatggcgagaccctgtctctataaaaaataaaaaaatagaaaataaataaaactagccagatgtaatgacacatgtctgtagtcccagctactggggaggctatggtggaaggatctcttgaacccaggggtttgaggctgcagtgagctatgatc

SEQ ID NO: 8708 - DNA, 506 bp, Homo sapiens
gaaggtaaaagtagttgcatgggcatctacttttttaaaaaagttcagtgtggcttccaaaacacactgaataagcacacatgccttagttgtaggaaataaaaactaactctggcaatcttattttaaaaatttaaaaagtgattttatttaaaagatattagagatcatataatgtgtgagagccctgcgagtatacagaaaaggattctgtaaggtctgaagggtcagacaacagaaaccgtagcaagtatattacagaacaataacaagaagttttgtgtgtgacttatagcggtcatgcatctgacctctaactatttccaagatttgcgtcccatcttttggaataaaagtctcctaatctttgagaggctgaagggggtggatcatttgaggtcaggagtttaagacgagcctggcgaacatggtgaaaacctgtctctactaaaaatacaaaaaaatgagctgggcgtggtggtgcactcctgtaaacccagctactc

SEQ ID NO: 8709 - DNA, 477 bp, Homo sapiens
taatcccagcactttgggaggccaaggcgggcggatcacgaggtcaggagattgagaccatcctgcctaacacggtgaaaccccgtctctactaaaaaaatacaaaacattagcctgacgcggtggcgggtgcctgtagtcccagctactcggggggctgaggcaggagaatggcgtgaacccaggaggaggagcttgcagtgagccgagatagcgccagcgcactccggcctgggcgaaagagtgagactccgtctcaaaaaaacacaaacaagaaaagaagctagttagctctgtcataactgccagtgattcatagtcccacatgtttcagagcaggcaggttgtacagaaagccaactaaggatgatcaaaaactttcagatgatcttgactgttcagttgaggtttgaaattaaaaatctatatgagcacctgactgtataattatgtaattttttttttccagtaatataa

SEQ ID NO: 8710 - DNA, 144 bp, Homo sapiens
ggattttgatagggattatattgaatctgtagatcaatttgggagaattgccatcttaatgatattaagtcttccaatttatgaacttaggatgtctttctatttacttaggtcttctttaatttctttttttttttttaaaaa

SEQ ID NO: 8711 - DNA, 590 bp, Homo sapiens
agacagcccagatatctattaccgtaagtctgcaaatatattgtacctagagttaaaatgcaatctcatgctctataagctttattgcatataaggaaaatgcctaagaaaaggccagtacctgaagaaagagctatgggaagggtcagctaaccagaaggcacctttttttctgacacagtgagaccatctaagaactgcaatgaatcagggaaatgaggctctaaggtaaaaccaggaaggccaggcagtctgcaaataaggggaagggaactatcagcatgaagctgtgattcagacaccagacaaacagtcagaaagtagagaatacagggcaagccaaggtcaagacagtgatgcatgaaaagccaggtccaggtcagaagaacagatctaacagtgagacattggagacttggtctcacccattcatcagaacctaacacagactacctccaacagagagctttggaattcttcccactgaagacaactgagacaacccgaaaagtggcccaaaaatgtaactgatatgtaggcagctatctcaatcacatgctgatccttcccacatttatggcaaataccat

SEQ ID NO: 8712 - DNA, 389 bp, Homo sapiens
aattttatatttaatatagataataaattgactaccccaaatggtggaatgcaaggatagcatattacaaggaaaatgttacaaacaactaacattaactagacaaaggatgaaataatcatttcaaaaaaggttgaggaggctatcagtaaaattcagtatctattactgataaaaatgttggaggaaaaagtgtatcagaaaatataatcatgggccagtcgcggtggctcacgcctgtaatcctagcactttgggaggccgaggtaggtgggtcacctgaggtcaggagtttgagaccagcctggccaacgtagtgaaaccttgtctctactaaaaatgcaaaaatttgcgcgtggtggcacgcgcgcctgtaatcccaactactc

SEQ ID NO: 8713 - DNA, 568 bp, Homo sapiens
tagctttgttttgaaagaaggtctgatggtgaaattaaataacaagttaggatcaaggagaccatttgagagagaaaaggatctaaattctagttctagaatggaatcccagacataacatataactgaccccaattattctttagctaaaaggtatccttttctacaacaggattgcagtcattcttttccaattgactcagcaatatataacctctttttattatttaactttattttcatagctctgacataagctaaactccatttaatccaaaaggatttttaaagtgtctatactggaaaagactacaatggaaaaggactgactttgtacctagagcaggccaggatgaaaacataccctaggaccagaacagcaaggagggatgggtttcaatggatggtgctctgaaaacagcctcttgaaatttagatgctggcccttgaactaattgtatgggtggagcacgttagctgcttcagaataaaaaccaattatattaacaaccaccctcattatgcaggacataatcaccatgaccatgtcaatatgtgtgtggaatat

SEQ ID NO: 8714 - DNA, 285 bp, Homo sapiens
ctgctcgggaggctgaaacagtgagacaggagtatcgattgaaccagggagttggaggttgcagtgagccaagatcacaccactacactccagcctgatgacagagcgagactccacctcaaaaaaaaattaataataatcaaaatgggtttattgaagtaataaaaatatattttagcattagaaactctagattaaggaagaaaaatcacatgctcttttaaatatatttacataaataattgaataaaatccaacatgccatatccactttcacacagaatg

SEQ ID NO: 8715 - DNA, 188 bp, Homo sapiens
gatttgagagatgcttgacttctttgctcaattattttatagaatgcagggtttttgcattttcccactttgtttcagtgctttccatggttaatgttggtttccttctcaggtcaaaataagagatcgcatctagaaatgataatcctcctccagtcgaggcagattttcttagaagcttcctagta

SEQ ID NO: 8716 - DNA, 149 bp, Homo sapiens
ggcacgaggagaaactgcattttgggggggtttgaaatccaaagaatgcagtttgtaggcagtcgagatccttgaaaaatcaagatggattttaataatgtattaagaataaattggatttgaatcaacacaggaaacagggattttac

SEQ ID NO: 8717 - DNA, 516 bp, Homo sapiens
ctttaaagccacagagatcatagagccttccaagcaggataagccactcatagaaaaattagcggagatttatgtcaactcctccttctacaaagagacaaaagctgaattacatcaactttccgggggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggattta

SEQ ID NO: 8718 - DNA, 407 bp, Homo sapiens
ggcacgagaattcataaaaggagttagttgcagtcatgtgtggccttgtctagaagcaaaaattataatatcaaaagctctacgtatgaattgggccttaatgtctttgtactcatttattcttttattgaaaaaaagctctaaatgcctattttgtgtcacataattgagatttgctttgaaatgtctgattctttactatagtactatctgagttgttcacagtggtatggtgatccatactctgaactgttccattatctggaattaaaggcatataataaaaagaaatagactgtatttagtttattctagtgtaataaattgaaaagtaaatagatgattagaagcaagtgttccaaataaaaatttatcagcagtataacaattctatcattcattccaac

SEQ ID NO: 8719 - DNA, 381 bp, Homo sapiens
ggcacgaggagagtctcactctgttgctcaggttggagtgcaggcatgtgatcatagctcaccgaagcctcaacctcctgagctcaagtgatcctcttgccttaacctcccaagtagctaggaccacaggtgggcatgaccacacctggctaagttttaaaatttttctgtagaggtggtgtctcactatgttggccagactggtctcaaatgcctgggctcaagcagtcctcctgcctcaacctcccaaagtgctgtatgattgttttaaataggaaaaaatttagaattttataatatcaaggcacttaatttttagttagtgatataccatccaaaaggcatctgaggctgggcacgttggttcatgcctataatccc

SEQ ID NO: 8720 - DNA, 537 bp, Homo sapiens
tcccatgaaatatcccctttattccatctcaaatccttacctatcaactccttgcccagagaacctggaataacatatttacttctagtccttttcaatgcattttccccttgggagaggtgagggggtggtgtgtgtgtgtacatgaaagaaaatcagacagattgaccatctttgacggtaactcaaagggataaatagatatagttaaccgataaaaaaacaacaggtgaaaccatgatatttcatgtcttgaccagattataagcactcttaggataaaagcaaggtgataacccactttgttcatggtgtattgaagtatctttcttagtggacactcccatttcaccccctctcatcacctgttctgaaatacatgctgggaagttgacaaacaagattctggtaaatttggagaagacagcggttcaaataaaggagaaaatttctctgtatttctgggaaaactgaaaatattcagtagataagcaaaatgttcaatttcatgttgctcttatagttataggtattcta

SEQ ID NO: 8721 - DNA, 452 bp, Homo sapiens
gtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaacc

SEQ ID NO: 8722 - DNA, 332 bp, Homo sapiens
tatctggagagatcataaaatacattacagttagagtcaacaatcaccacttgaagaaatggcttcaacacaaagcctgataaaatttacatctggtaaatgtctatttaagctactgcgaaacacatatacttaaaaaaaaaaggccttttcattgcctcaatgtcttgaaggctggagattgtaaagcacttccctaaagttcctatgagcaggatgaggctatttgcctttatagagctatagaactaataagcaatcaaaggggattttgaaaaaagcctataacttccaaagtgataaactgtggaaatattcattggacctgtccc

SEQ ID NO: 8723 - DNA, 405 bp, Homo sapiens; identical to SEQ ID NO: 2928

SEQ ID NO: 8724 - DNA, 389 bp, Homo sapiens; identical to SEQ ID NO: 398

SEQ ID NO: 8725 - DNA, 304 bp, Homo sapiens
acttaagtagggaaatcacaaaataagtgccaatgaacaataaatgttcaacctcactacagttaaaatgtatattaaagcaagagttgagatgacacttttccttataaaacagacagggattcagggacattgggactctaatgctgctggtaagacatgaataaatacataccatctctggcaatcaataccagaagctttaagcattgccttttgactttgaaattgtacctggaaatgtatgtttcagtaaccatcatgaatgtacacaaaatcctgaaactcttaaaactgatgtcac

SEQ ID NO: 8726 - DNA, 459 bp, Homo sapiens
ggcacgagggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcaca

SEQ ID NO: 8727 - DNA, 596 bp, Homo sapiens
agtattagagtaacaaataatgaataaacatagtggttactctatagactgatatcttcaattactgttcctgctttttgtaagcttttaaatggttcccattcactgaacacttatgtatccagtaaagtagataacataggtgctttatatacttcatatttgttagtccttaaatctgttgcagatattaatagtcctcttttttcagatgtgtaaaactgagtttcagtgtaaactgaatctctgagagattaagtcattttctcaaggttcagaacagtaagtggcagagtaagtgcaggattgaggctagggtctttctactccaaagcctaaccctgtccgtcccagagtgatacaatattataacctacgccctgatatttaacaaaattaaagcattcttgggaatacttctagttttcatagaaagatcctcaatcaagatcattctggaatgtgcagaagataaaaagaaatgggatggcaaaacgcagagaaagcaaggcaaatgaaagctacaaacctctcccttagataaatgtacacatgagccgggagcggtggctcacacctgtaaccccagcacttcg

SEQ ID NO: 8728 - DNA, 409 bp, Homo sapiens
attattaaagctagttctgctactctagaatggcacttttacatgatggcttttccaatatttgcaactgtggtaatcttaacttttctcttctccagatgaaattttgtctgttccattcagagcttcctctcgtgttttaattccaggcttcttccacattctggtcacctccttgtgaaaacattctgattcagtttatccttccagaactgaaaacacactactaattctgtagcccgagctaagtataaagggacacagcaagggtttcctcactttgcgtaatagtggaggactgaaaaatgactgtgaaacctgaaataatgcaaagtgatcctagtgggaaaaatgatgatcattctgagacctttataaactgctttttttttttttttttttgaaaagg

SEQ ID NO: 8729 - DNA, 568 bp, Homo sapiens
tggtggcgcatgcctgtaatcccagctactcaggaggctgagacaggagaatcacttgaacctgggaggcagaggttgcagtgagccgagattgcgccactgcactccagcctgggtgacagagcaaaaactccgcctcaaaacaaaacaaacaatagaaaaaagtaacaaaaccaaactgtggttcccagatcaatgtaattgataaatccctagctagactaacaagagagagagaatacaaattatcagttaataccagcagtgataaagaaaggatatcactagggtgggcatagtggctcacgcctgtaatcccagcactttgggaggccgaggcaggtgaatcacttgagatcaggggttgtagaccagcctggtcaacatggggaaaccccatctctactaaaaatagtaaattagctggacatggtggcgtgtgactataatccctgttacttgggaggctaaggcaggagaatcacttggacctgggagatggaggtggcaataagccaagatcatgccactgcactccagcctggatgacaaagcaagactccattgc

SEQ ID NO: 8730 - DNA, 587 bp, Homo sapiens
  misc_feature 68: n = A,T,C or G
tcatgggcaggagccactgcgcccagccattctagctcgtgttttgctgagcatcgtcgcatgtcttntggggtacacacacaggagtgaggtagtggagcaccggctaggcgcatttttagcgttaatcgatattgccaattcatttccccagtttacgtgcccaccagcgttgtagacaagttccagtttctccacatcctgaccaacgcttattagaataaacttttgaactgtttttgcttttagttcttccgttggtgacctccccacttgcagatcagcagatcaaatccccatgctgttgacaacacgctgggagcaaagagccaggtggagcttctaacgaagtcagatcttctgatattttaaaagctgagataaaattcacaggccataaaattaacccttggtcgggcgtggtggctacgcctgtaatcctagcacttcaggaggccaaggtgggcagatcacttgaggccaggagttcaagaccagcctggacaacatgacgaaactctatctctattaaaaatacaaaaattagccggggcgtggtggcacatgcctgtaatcccagctactca

SEQ ID NO: 8731 - DNA, 551 bp, Homo sapiens
agacgacagaagggtcggcctcccaaagtactgggattacaggcatgagccaccgctcccggtcagcagtttttattctgttgaccatttcttccttcctgaagctcttctcattaggactatagattaccattcatatattcaacatctgaaataaagatgcttatactaactgagctctgtgtgtgtcagctctgtgacaaattctttacatgtattatttcatcctcccatccatttgatgagataggacaataatcactctaatttaaagaaaccaggcttagtagtttgctgaagatcatgcagtcaaggaaatggtagagaaaggggttcatgtccacatgtgttagttatcaaagcttgtgtccttaaacagtgcatgtaataccacctcctcatgccaggtatcatgttggggcctggaagtaaggaggtgaaaacacctcagatacagaggggaaaacacttagtactcagggaactatgatacagtggaaaaaccaactaagcagatagaatgtgatgatttcaataaagaaggtataatt

SEQ ID NO: 8732 - DNA, 501 bp, Homo sapiens
  misc_feature 312: n = A,T,C or G
ctgtcagcaacatattactattacaaactctgtaaacatgcttctgaacaaaatggtgtattcacaaaaaattttaattacttaagtcataaaaaatcagtctagcatcaactcttctgaaagtttggttctatattaaaacataaaaattagctgaagagacatcttgctaagcttctcagtcactgaagagcaagtcaagaagtccacaatattcttaccaatatataaacactggaaaatgttccttctaagcatgataaggatgtgaacaacagcacctctctaatgactaaaacttctgttcctcanaaaatacatcattagccaacaactttctggcagaagttgcctttaattggcatttgtacataaccaagtgttagtctgtatttacaccgtaagttaatttggacaaaattaaaagctaattgatcacatatctcaacctcagtcataaatagtgtgggcccaaatatcagtctccccatggatttatgc

SEQ ID NO: 8733 - DNA, 611 bp, Homo sapiens
atatgaggaaactaggcttggaaaaatatagtaatttgcagaaagtcttacaattagttagtgcagctttaattggaaagtttatgcttctttttaccaccatggtatactttccactgtgggcagttgtcttatcagggagggaatgcagttgtttttgctctccttttttaaagcactgaaatgttagaggttactttgataattggattggttagctaattagaatatagagttttttgtttgtttctatttaaagagacagggtctcactttagttgtcccggctgaagtgcattggtgccatcatggctcactgcaccttcagcctcctggcctgaagagctcctcctgcctcagcttcccaaagtgttggcattacaagcatgagccagcgtgcctggcaggaatgtagttctttttttctttttttttcttttttgagatggagttttgctctgtcgcccaggctggagtgcagtggcgtgatctcggctcactgcaaccgctgcctgtagggttcaaataattctactgtctcagcctcccgagtagctggcactgcaggcacccgccaccatgcccggctaatttttgtatttttttttagt

SEQ ID NO: 8734 - DNA, 584 bp, Homo sapiens
agtataaaaaattcttttattctgaattataaattctgactataaaatacatacgttttgagataaattgtgcatataagcttttagccgaagatgagtgtgttttaaagatgatatgtagctgggtgcagtggttcatgcctataatcccagtgctttgagagtccaaggtgggaggactgcttaaggcccagagttcaacactagtctgggcaacccatctctagtgagacccccatctctactaaaaaataaaaaaatatggtggggcatggtggcatgtacctgtagtcccagctactccagaggctgaggtgggaagatcacttgaactcaagagtttgaggctgcagtgagctatgctcataccactgtactttagcctgggtgacagaacaagactctatctctaaaaaaactcaaaaacatatatatatgcattttatatttacctagttggttgtatgagtctaaaatcttaatcactcaaaaacatattaccgccgggcgtggtggctcacgcctgtaatcccaacactttgggaggccgaggcgggtggatcacttgaggtcaggagtttgag

SEQ ID NO: 8735 - DNA, 311 bp, Homo sapiens
cttcctcaacctgctatgaatatggctattaaattaagaacttaatagatctcttgctcctttttgatctcaaagtgtcttttggagctaaatttgcaaagaaaaggccctcattaaaaaaactaagtaaatttaaggccaggcacagtggctcacgcctgtagtcccaacactttgggaggccaaggcgggcagatcacttgaggcgaagggtttgagaccagcctggtcaacatggagaaatcctgtctctactaaaagtacaataattagccagacatcgtggtgtgtgcctgtagccccaactactc

SEQ ID NO: 8736 - DNA, 528 bp, Homo sapiens
atcttgcatatgttactctttttctaaaataaaaaataaattcaacattggttgtcaagtgtcttcattaatcatgaatgccccaatgcagtgtaatatagaaagcatggttttcttttttttaagaatgaaatgtaatctttaggggtgacatttaaaatatgtttctttttagcaaaagtcttatgatctttctttgacatattctcacctggataaatttaattttaaattaggaatggtaaaaattgaaaatctttttatttaatatgtaatatcttaatcatgaagataaagtttaataggactgcatgtttatgtttgtattaatggtaggacatggagatgtatcaatcaaaccaataaaactccagtacacataatataaatgtcatcttgctttggtgggtgagtagcattgtgaacaggatttcttgtcaagttggtgctgttattgaggatatgagaagcaaagttcttgagtaggtaatattcatgcaaaattttctgtttctaaatatcttctaa

SEQ ID NO: 8737 - DNA, 235 bp, Homo sapiens
tatttttgttaactattaagcattattgagcacttatgttgccaaccactacaatgaggatttccatatacataatcactgagtcctcataataatactagaaggtacaaacagttattacgcccattttaaagataatggatgttaatcggcatgaccaatatcacacctaagaagcacaaagacttgagcccagatcaatctgtctcctggcttatcatgatattaactaatg

SEQ ID NO: 8738 - DNA, 172 bp, Homo sapiens
gagggttgtgctctccaaatatggccccactgagacacgcctccctcagcagactttcctgcagacgggtgtactgacagacggatgttcagacacgtagacattcagagagacacacagatgttcaaacaagtgcattctggctgggtgggtggctcacacctgtaatccc

SEQ ID NO: 8739 - DNA, 549 bp, Homo sapiens
gtgatagaaatatatattgagaagataaagagaagaaaatacgttgattcaaatggaggctagtgtaaaggagctataacctcatttaataataataattcataagtcaagaagcagcaataaaatcatgttatttagaaacatggagataaatactagaagaaattgctaaaagatttaaagtagttgccctggagaacagaaatggaggttggattgaacagaaccagaacttctatttttcagggttgtagtgtagttttcactttttaaactatgagtgtgtttctttgataaaatagaaaaaatatataggttctaaagagttaaatgaagctggatgtgatagtgtgtgcctgtaatcctatctacttgggaggctaagacaggaggatcgcttgagcccaggaatttgagaccagtctgggcaacacaaagagacctcgtctcaaaaaattaaaaataaggccaggcgcagtggctcacacctgtaatcccagcattttgggaggctgaggtgggtggatcacctgaggtcaggagtttgag

SEQ ID NO: 8740 - DNA, 382 bp, Homo sapiens
actccagacacatcttcaattgctgctggaagattaagggaagctagcaccctgaaaaaatgagatactatgttatattgaagtctaaaacaatttaactcatcaatatttattttatttaatttaatcttctataaccaaatcaacagcaatggagttagcacccagaaaaactggataagccctatcaatgaaaaacaaagcaaagattaacagaaaaacaaaaaaatcagtgattgatacaattaaaccaaaatcattaaaaaattaagttcacaattcagaattaaaagccaaaaaataggctggtgcagtggctcacacctgtaatcccagcacttgggaggccaaggcgggcggatcacctgaggtcaggaattcg

SEQ ID NO: 8741 - DNA, 657 bp, Homo sapiens
agacagcgtctggctctgttgcggaggctggagtacagtggctcaatctcagctcactgcaacctccgcctcccaggttcaaacgagtctcctgcctcaacctcccatgtagctgggattacaggcgtgtgccaccacgcccagctaatttttttgtatttttagaagagacaggggtttgccatgttggccaagctggtctcaaattcctggcctcaagtgatctgcctgcttcggcctcgcaaagtgcttgcaattacaggtgtgagccactgcgccaggcccaatgacaagtttttatatctgaaaatccctagggatcaagggaaaaatttatacaaataatgtgagcattctgtaaagcagcacgttataaaatgagtaactaccatgaaaaaccaccatgtaatctaggaatgaaaaaactaacaatcttcatatattcaagaaaaacaagataaaatggaagagaaggcaccatttatgatagcaaaaaaaaatcaaatacataaagttaacaagaaatctacctgcagaaacaccacaatattcctaaaagacacaaaatagacttgaactaatggagagataaaccatgttctttgatgggaagactcagtattatacagataatgatgctcattaaattaattttta

SEQ ID NO: 8742 - DNA, 429 bp, Homo sapiens
acttctagaatgatggaggtgataattctgcctaactccacattggtagaaccacatctgggatatcatgttagtgcccggtgacagattagtgcaaacagaggaacatgactggattgctaaagagctcaacattctgccacaagagggacaaaaaaagtaaattggaatatataacttgaataagaaaatactcacggaggctgggtgcaatggctaatgcctgtaatcccagcactttgggaggctgaggcaggtggatcatttgaggtcaggagtttgagaccagcttggccaacatggtgaaacccggtcctactaaaaatacaaaaattagccaggcatggcaatgcatgcctgtaatcccagctactctggaggctgaggcacgagaatcgcttgaacctgggaggcaggggttgcagtaag

SEQ ID NO: 8743 - DNA, 441 bp, Homo sapiens
gagagatcattcatttaaaaaaatttttaaattggcataatttttggcatataacccaggagcatttcaaagaattgctatcacaaaactccttttatctatgtatttatgttaacaggtgttctcagcacatacatctacttgaaagtgtaagattaactctgccacactttgctcatgcatatataaaccaaatgggaaaatccccatccattttagtaagagttatatttccaataaaattttgtaaataattaataattacttaaaagttacatatgggccaggcacagtggctcacacctgtaatcccagcacttttcgaggctgaagcagaggattgcttgagaccaggagttcaagaccagcctgggcaacatgataagacccccatctgaacaaaaaataaaaaaaactacctgggcatggtggcacacacct

SEQ ID NO: 8744 - DNA, 497 bp, Homo sapiens
  misc_feature 397: n = A,T,C or G
atttacctgtcatgggtttgttcttcctacaaattttaagtcatacttatgagcttcatattaattccaatattgtaatgagttgaaaatgatgcagagaagttatttctacctgacttgaccttttggacccaccctaaattctgtttaataaacattaaccaaatgcactgagtgctggacatggtgactcatgcctgtaatcccagcactttgggagaccgaggcaaggaggatcacttgagcccaggagttcaagaccagcctgggcaacaaagtgaactccatctctacaaaaaattttacaaattaactaggcatggtggcacatgcttgtagtcccagctactgggtaggctgaggcaggaggacaggttaagcctgggaggttaaggantgcagtgagccgtgtttgcaccactgcactctagcctgggtgacagaatgagaccctgtctcaaacaaacaaacataaaaacaaacaaaaaccaaatgta

SEQ ID NO: 8745 - DNA, 406 bp, Homo sapiens
ggtgggtggaggtggggtataggttggcaattatggatactgagtgccttgtttgaagaaaatcccccaacccctccaagcctgaaaactttaagtcatgaagaaagtagtagagaattggccgggcgtggtgcacagtggctcatgcctgtaatcccagcattctgggaggccgaggtgggaggatcacttgaggtcaggagttcgagaacagcctggccaacatggcaaaaccctatctttactaaaaatacaaaaattagccgggcatggtggtggcgtctgtagtcccagctactcaggaggctgaggtgggaggattacttgaacctgggaggcggaggttgcagtgaaccaagattgtgccactgcactccagcctgggtgacagagttagaccccctct

SEQ ID NO: 8746 - DNA, 443 bp, Homo sapiens
cagaatagatgatgttcatttatataacattctagaaaatgcaaactaatatatagggacaaaagctaatcagtggttgtctgaacccaggagtggagggaaagatgaaaaagggcatgagaaaacattttggtttgatagtaaaggtggtttcatgaatgtacacatctgccaaacctttaaatggatacagttagttgtatttacagtatactttaataagttaaattatcagcataaaatttttaaaaatcagtaactggtcagctgggtgtggtggctcatgcctgtaatcccagcactttgggaggccgaggtgagtggatcacgaggtcaggagatcgagactgtcctggctaacatagtgaaaccccgtctctactaaaaatacaaaaacaaaattagccgggcgtggtggcatgcgcctgtagtctcagctactc

SEQ ID NO: 8747 - DNA, 567 bp, Homo sapiens
gaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccatctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgac

SEQ ID NO: 8748 - DNA, 512 bp, Homo sapiens
  misc_feature 455: n = A,T,C or G
aagtgacatgatctcggctcactgcaacctctgcctcccaggttcaagcaattctcctgcctcagcctcccgagtagctgggattacagctgcttgccactgcgctcagctaacttatgtatttttagtagggatggggttttcccatgttggccaggctggtctcgaactcttgacctcaggtgatctgcctgccttggcctcccaaagtgctggtattacagtcgtgagccaccgcacccagccaacactgggaatttctgttcaagatatgctgtgaatatcatgctgtgaagcataatattgattctatacattgtcagttagatgactgttggatgctagagaggcaaatggtcttataataatatttaataaaatataattattgaaagtgtttaaaatcagctttattagtgacttgcatttaaatttggtattttatttaacaattntaaaagatatatttaatgatatctatttattatattttcttgaacagtttgtgtctc

SEQ ID NO: 8749 - DNA, 433 bp, Homo sapiens
aattttacagccagaatcagtttgattatttaacaccaaatagtgacctccgtataaattatatatttaaatcaattggtattaaaccaaaagatccaatttttaaaataaatttgatgtcctaaaattaagagactgacatcaattttatcatgaaaaattccattataatccctactacttgagaaattagctgctcaatattgacatggacactgagaagaaaaatacattttggcataaaattaggaagaataaaattattattatgggaggcttcatattcaaaaacaactaaagcattttaaaatataccatttacaataacaaaaagagagttaactgctcggatcccattgaagttcatgaagttgatatactgtagcaatcaaaattctcaagattaatatttcatgacagaatacctggattt

SEQ ID NO: 8750 - DNA, 101 bp, Homo sapiens
gcactcagtaaatgttcagcaaatgggtgaatggatgataaaattgatagtttaagtagttttttttaagttgtttttctttttccttcgtggaaaaccgc

SEQ ID NO: 8751 - DNA, 355 bp, Homo sapiens
aggatggccgggtgtggtggctcatgcttgtaatcccacctcagtcttctgagtagctaggactatgggtgcacaccactatgcttggctaatttttgtgtatttttgtggagatggggtctctctatgtagtccaggctggtctcaaacacctgggctcaagccatcctcctacctcggcctcctaaagtgctgggattataggtgtgccccaccacacctggccctcccttatatttttaagcaaagtttctagagataatggaggatttaaaattttagcttttctttaatcctgttcctttcttggcaagtggtacaaagaatagtataaaaagtaaggatctggcctggt

SEQ ID NO: 8752 - DNA, 565 bp, Homo sapiens
atgtggtgcccaagtattaaagtatctactatccctactttttcgtccttcatgagcagcccgagtgtactaaacacattactgttacttttgtcatacaaagtttcaaacaccagtgagaatagtggaatgaaccacccttgtgctcctctagctttaacaatgtatacctgtctacttcctctcccaaataattttgaaggaaatcctagacattttatctgtagatgcactatatagctctttaaagacatctaaactctctttaaatctagagtctctttgtccccttgcagtgtgtttattggagaagttaagtcattttcctggagagtttcccagtcttgattttgctgattgcaatctcatggcgtcattaagtgtattctcctgtatgctgcatttcctgtaaattaatagacctagagaaagcgggtgtgtgtgtgtgtgtgtgtgtgtgtgtgtgtgtgtgagaagggtctcactgtatcacccaggttagagttgcagtgttacaatcagctcacgcaacttctgtctcctgggctccagcgatcgtcccacc

SEQ ID NO: 8753 - DNA, 613 bp, Homo sapiens
  misc_feature 458: n = A,T,C or G
tacggctgctgctgaagactcagcacatgtgtgaaataaagtatacctgaacatagcccagagaagcagcactgtggtttctgtgggagcagcttcagatgcgctcacacagtgggatactgtacaatgcttaaaacagttaggtggagccatatgtgtttcaacacaagtaatgagagctatcgagatggagacagacagacagatatgttacaagtttaaattcctggctctatagaatttctcaaagaggttccctacagcaccccaaagagactcatcaagattgtgtctttaaaaatacccagtcccggccaggtgtggtggctcatacctgtaatcccagcactttgggaggccaaggcgggtggatggcttgaggtcaggagttcgagaccagcctggccaacatggcagaatcccatctctactaaaaatataaataattagccaggtantggtggttcatacctgtaatgccaggaactgagaggctgaggcacaagaattgcttgaaccgaggaggcggaggttgcagtgagctgagattgcgccactgcactccagcctgggtgatggagtaagactgtctctaaaaaaaaaaaaaaaaaaa

SEQ ID NO: 8754 - DNA, 259 bp, Homo sapiens
tgcttagactatgcttgctcaatgtttatttttaggaaacaatcaaatccccttgtggttattaaattaatttagtatcaggccgggcgccagtgacctcaggagtttgagaccagcctggccaacatggtgaaaaccctgtctctacaaaaatcccagctacttgggaggctgagacacaagaatcgcttgaacccagaaggcataggttgtagtgagctgaaatggcaccattgcactccagtttgggtgacagagc

SEQ ID NO: 8755 - DNA, 414 bp, Homo sapiens
gtagctgggattacaggtgcacaccaccacatccggctaattttggtaattttagtagagacggggtttcaccatgtcggtcaggctggtcttgaactcctgacctcaggtaatccgcctgcctgggcctcccaaagtgctgggattacaggcgtgagccatggtgccgggcgttgggactgagctcttaactcagggagtctttgttaattcattagcatcagaattgaactgaacagtaggatgcccggctggtgtcagagaattgattggtatagcaaaaagccccacaaatttggtgtcagaagtgaaggattgagtggtgtgagtacagagagaaaaacgattggtctttcctgtattcactgatccatgtaacaatacagaaaagtattttgattgattctaccattt

SEQ ID NO: 8756 - DNA, 430 bp, Homo sapiens
cagaagggaaaacagaccacacccaacacaatcaactgacctctaacaaagcaccagaagcaatttaatgaagaatggatagtctttttcaacaaatggtgctggtataacagaaggtccacatgcaaaaaaaggaatctagacacagaccttacacctttcacatagggctcacagacctaaacataaagtgcaaaactatacaactcctagaagataacatttggtaaccttgagtttagctctatctttttagatacactaccaaaaggacaatccatgaaagaaaaaactggtaagttaaacttcattaaagttaaaaactgctctgcaaaaaccactgttaatatgattcaagaacatgattttttaaaaatacactgttaaaagaatgaacaggccgggtacggtggctcacgcctgtaatcct

SEQ ID NO: 8757 - DNA, 137 bp, Homo sapiens
gagcatgtctttcttatctccatatgctttgtataggcctggcacacactcaacaaacatggggagtgataccttctaagagaattataactagaatccttaaaaggtaaacaaaacatattaaaaaatggaaccca

SEQ ID NO: 8758 - DNA, 544 bp, Homo sapiens
gacagaaggggactaacggcattttcattcgtgaacagttcagattaactcataaacaacagaaacattttcacagccagacaatggcactctgtccgctgtcaatatttctcatgttttggaagaagcctgaccaaccaggatgacctcttgccatagcagtgtggctattcaggctagttccaggacgcagtgcttgtcccaatgtaattacatatgctgcttgacattagggagccactggagaagtttattaaaagtaatttccggctggccacagtggctcacacctgtaaccccagcactttgggaggccgaggcaggaggatcatgaggtcaggagtttgagaccagcctggccaacatagtgaaaccccatctctactaaaaaaatacaaaaaaattagctgggcatggtggcagacacctgtaatcccagctacttgggaggctgaggcaggagaatcacttgaacccaggaaaccgaggttgcagtgagccgagatcacgccattgcactctagcctgggcgacagtgtgagac

SEQ ID NO: 8759 - DNA, 500 bp, Homo sapiens
  misc_feature 343: n = A,T,C or G
ctataaattgtgtataacagtaccctttctaatactgtcatgatgcttctaagctgagaggatggacaaaatgaatgtggtaaataacgcatgaatatattatataaaaattaattttaaaacatatactttttccgtaactaatcaataaatgaatctgcatttcccatagcaattatatccgttgagaatagatttagctgcaagttgtagaaaatccaaaataagagtgccataatagaagttggtttctcccttctagggagatagttccgaggtaaatagtccagggctgttttagcaccccatggtgcaagggactttggctttttccatgtagctntactctgtgtggcctctgtattatgacccaagacaatagcacctatgttcaaacagcagaattgatgaagggatgaaaagaagaggcaaattgtgtgtgccacttgtctcttaagaatgttttccagctgggtgcagtggctcacgcctgtaatcct

SEQ ID NO: 8760 - DNA, 302 bp, Homo sapiens
aatcctatcttgcttgtcaggaagattgcctgctgtgtcctcagcctcctacggtcctaaatgcaattgggaaatggctggcaggttctagcagggaactggcatgatcttttgatctatgcttttaccacttttcttttgagacgaagtcttactttattgcccaggatggaggacagtggcgcgatcttggctcactgcaacctctgcctcctgggttcaagtgattctcccacctccgccctccgagcagctgggattacaggcacatgagaccatgcctggctaatttttgcattttt

SEQ ID NO: 8761 - DNA, 407 bp, Homo sapiens
caaaaatcaaaagatgccttaattcccccatgggtgggccccatgctcttgaagtaagtgctgtgctacttgaagcagtagtaggaagaacccatttacaccatctccccactacaacttttatgccttcagaaagtgttaaaaaactgttacaaatagccatgttgtgtcttggaaaataagttctccagaaaacacctctctgagctaggcaatgtgtgtttctttctgtggttggcagaaataagcccaaatacagattctgatgcttaggaggaagaatgtggtagaaacataacagatttgcaaagtctatcttgtagcatgatttacacttcctcacaagcatgcttcctctgaccttagcctctcagaatgtggggatgataaagggatgcctcatcagc

SEQ ID NO: 8762 - DNA, 283 bp, Homo sapiens
aagacgacagaagggcttgctatgttgctcaagctggtcttgaacttcttaagggatccttaagggattctctggccttggcctcccaaagtgctgggattacacgtgtgagccaccgcacctggcctctcttcctcttgatagtgttatttatccctaggaattgggaggaaacctagctttctaggacccactgagcggatctttgtgccctgaagagcacctttaaatgttagattccagccgggcgtggtggctcacgcctgtaatcccagcactttgg

SEQ ID NO: 8763 - DNA, 492 bp, Homo sapiens
aaacggctaagcctgaatgatggggtgtgccccggatgcctcagacaacagataaagctactccagccaggaagacacagaagtggaagacggagataaaactgcatgaaacgaagggataaaggaagagcaggatttctaaatgaagataccggttcctaaaggatgcaacctgagagaagcataatgaccatatcagcctatttataagcaggcagttaactcattcatcactctgtagctgacgcctgtgcccccagctgcactcacatggcgtggtgagctttcacctgagtgcggcagttacggccccagtagcagtcaggacgggatgttacggccactggaaaaagagaaggggtacgcatctatgagatgtattgcacgcacccactcagctacctgaatcccagcagagacccaacgacagacgctgcggtggaaacgcacggcctctggtccctccataactagtttcctcggaccgttctg

SEQ ID NO: 8764 - DNA, 239 bp, Homo sapiens
gcccaatatagtgatccagattgagatcctcttctttttgtatgtgtctggattttgtttgctagggttttcaggatttttgtgtatatatgcatgagatactcatctgtagttttcttgtgatgtctttgtttggttttggtatcagggtaatactcgcctcaaagaatgagttgggaaatgtttccttctcttctgttttttggaagagtttgtgaagaattgatcattctttaaat

SEQ ID NO: 8765 - DNA, 499 bp, Homo sapiens
caggtaagcctacaggctaaggcagaaaagtataaagataagaagaacctagatccatcatgccatagttgatctgttgaattaccactgctgaatctgttctacctccaaacattttgttatataagatgatgaatctcatgttgtataaccctcttgtagttagattttctgttatcctaggccaaaaatatcataaagaatggcacagacatttagagaaatgagttgaggacagaccatgaggtcccagggagagagaaagagataaagagagtaatgtagactttttaattttttatgaggtaagctatacttttttatttttgattactcattaaggaattttcctgtaccctctaaaatgtatccctatttatttgtattagtaaacagttttcaggttcttgtatccaaatgatctctaaaaaagacaacatatattatcacattcaatccccatgacaataactctgtaagttaaacatttctttttgct

SEQ ID NO: 8766 - DNA, 640 bp, Homo sapiens
ttatattattgtttaaacatagttttgaaaatatatactaaaaaactgataagcacttcttatgataaactagggtctgtgcttcaaagaacaatatttgtcatttttcagtatattaaaaaaaggtgccttaggctttaaagatgttagaaagaggaatcagacacacatgcacacacacacgagttattgcaacaagatggaaataagagtatatcctatttctcagtctcattctattacagcacatcatttaagcagtttggtaatatgatatcctgagtgtgaaggcaaggtagattcattcctctagatgtttacttctttgattttaaaaactgaaatatttactcctctcatatcaatatcagaaaataccactggccttgaaatcaactttaattcttcagataaatatattgagaaatatctttactatttctgcttcacaaaattccagttcagcaccagtaaagacatataattttataaaccaaggaagacaaagagaatagcagagagcatgacaacagatgggagatgtcagtgaaattatagaagagtaaattagtttagagtgttaactgatttagacgagcagtgaacactgaaatctaagtgttaaaagaaaagccacacc

SEQ ID NO: 8767 - DNA, 552 bp, Homo sapiens
accctctctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatattttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacac

SEQ ID NO: 8768 - DNA, 438 bp, Homo sapiens
gcacgactgaatcctcagagtcggctggcttttgagctctcacgattggggaggagggggcgtgtctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagct

SEQ ID NO: 8769 - DNA, 316 bp, Homo sapiens
actgcaaactccgtctcccaggttcacaccattctcctgcctcagcctcccgagtagctgggactacaggcacctgccaccacgcccggctaatttttttttttttggtatttttagtaaaaacggggtttcatcatgttacccaggatggggtcaatctcctgacctcgtgatccgcccatcttggcctcccaatgtgctgggattacaggcatgagccaccacgcctagccatccccatctatttttcactaatattcaagctagagttgctggctaaaatgatggagcatcaaaatttgtgaactctgggaat

SEQ ID NO: 8770 - DNA, 403 bp, Homo sapiens
  misc_feature 344: n = A,T,C or G
taaatcttaaatctaaataaaggtgctctttttgtttgacttacagcagtgttttaagtcatgtatgagttcgctgttcagaatatcattgttccgcattaaagtatgggacagaaacacagtatgagacagttttagaaatattgctattaatagcaataaacaaatcttcacaaatatcacagaacagtgtaaataacttccctctgataagacatagactaattgtgaattcaactctctaaatgcttggcctcagtttaaaaaatgaatgtagcacattttttcacatagatcatggtatcagaataacaagaatgtttgaatgtctacagtctgcattntatccatcaagaaaacagtagattttgaaatgctctattcagctatgtgtaaacttaat

SEQ ID NO: 8771 - DNA, 432 bp, Homo sapiens
aaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatg

SEQ ID NO: 8772 - DNA, 471 bp, Homo sapiens
ggcaataaaatgtgaaacccaacttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacatcatgcatgcaccaacacctaaaactcaaaactaaatggctattttgtaaggttaatacttgcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaact

SEQ ID NO: 8773 - DNA, 474 bp, Homo sapiens
aaagcccaagttcagctaaggtcttgtaggtaaccaagccctggctctttccactgctgctcactgccgggtgccctgagcacaagagcagtccccgtcattactcccaggcccactgttatgggcacgtctgctttccacagactgcctgtatccaagggtagagcccctcttcctcctcttgcatccaggtatcctgaagtttccacagctcctgtaaacttggaaacaaggaacccagcccctcgggtgccccaaagccatcagtttctcccttgctgcagtcacccaggaatccacctgtaaggaatatgacttctgtgtgctctcacagctgtgtacatcgatcaggtcaaggacaatagtcaatctactgacaccactttataaagcttgctacagtttaagattatcatgctgagaccagcctgaccaacatggagaaaccccgtctctacttataacacaaaattt

SEQ ID NO: 8774 - DNA, 600 bp, Homo sapiens
gaataatttatggacactgctggacctcagtctcctcatctgaaagatgagtggttggagaagtttaatggttttcaaatgctttttttttcagtcttcaaataagtgtttacgtagaagcaccatatctgaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcacccccagccctctccccatgctgctgat

SEQ ID NO: 8775 - DNA, 443 bp, Homo sapiens
aagaaatgatttttaaagaagacttaattaccactctatgtgtttttaatgctggctgaaaatacacaagaagacaagctaaagtgacatgtgacaagttctcatttagtctgtcagccatgatagcatattcagaaagataaacaataaaaaaaaaggatcaagagataaaggtagatcctcccatgacctcaaaataattatagtatttgctggtgaggccaaagtttctgtacacagatacctgacatagacagctctatggaattcaagggaaaattaggggaggggacaggtgacaagctcagtctgtggtattaatcgagtagtattctgactgagccccatctgaatttttatttacccattctaatatttcctggaaactaaggctttttacttctctctcagtctactcaaaatgaactactccccaccccaag

SEQ ID NO: 8776 - DNA, 397 bp, Homo sapiens
  misc_feature 150: n = A,T,C or G
ggcacgaggtcttcactctgcgacaacaagcttcttgaaggcaaagaccatattttaagtatcttttgtgtcctagatgcactgagtaaaataccagggatgccgtagatcataaatatgttataatatttaaaaatagactctaaaatntatatttacagaaacattgcaaagatactgcagagtttctgcctatcctacactgtttcccatattattaacgtcttacatccctgtgatcatttgtctgtattaataaaccagtattgatacattatcacagagaccatactttatcaggtttccacaggatttttccttaatgttctttcactatcccacgatcccatgcacaataccacattacatttagtaattatgtctccttagctcctct

SEQ ID NO: 8777 - DNA, 396 bp, Homo sapiens
  misc_feature 263: n = A,T,C or G
aaattatcaaaatggatattaggttggctactagcagtcttggcctcatgctttcagtaaatagtgtgcacttcagatcatgtggcattggagaaaggaagaacatgttaataatataacatggttaggtcatggagtcttgattattgtttcctaatggtactgtttgacttcataggctacaagacaaatttcttcaagtgtaaatttttcgattgaagaagacataaagcctttgagaatttactgtatactcagcactntgccgggtgtaggataaggatacaaaatcatgaaagcctaatttctttccccagagacttatgaatgtggctgaaaagaaaaagtacaacacatgcaaaataattatgaaataatgatgtatgacaggaatgc

SEQ ID NO: 8778 - DNA, 413 bp, Homo sapiens
ggcacgagggaaggactacggtttccgcaggtaagaggcagttgggggccatgggcccagtataggaggctgagctccttccactcctcagaacctccactctatggatctggacctctggaattcagctttctccctgggcactgacttcaggaacacggcgaaaattgaccttacacaatcccagcgccctcctcacaggagcctttcactttacagtggcaaggggctggttctggagaactggctgatgctctgaatttcttcatataccccacatttgactttggcttacactgtacaataggagatgttgctacaggtccctgagatgcactcacattaagcgtatcaagcattgccaatgggaaagtcaaagataatctattttttttccctttgcccctacccca

SEQ ID NO: 8779 - DNA, 578 bp, Homo sapiens
ggcacgagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttgga

SEQ ID NO: 8780 - DNA, 299 bp, Homo sapiens
gcacgcccccttttctccgccacttcaccagtttctgaaatccaacctcccagacttcacaggaagatagatattcttgagataatgaaaagtgatatcttcgcataccataggagaaaaggctgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagtt

SEQ ID NO: 8781 - DNA, 511 bp, Homo sapiens
ggcacgagatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgtaccatttaatcagtaaatgtgtcccctggtgctagcatggtgttatagaaagtggacaggctttagagttaagtgaatctgggttcatatgttagtgttgctattcattagctctatactgatgaacaaattgcttacactatctaattttgtggtttttttttccatctaaaatagggataataatatctacctcataggat

SEQ ID NO: 8782 - DNA, 524 bp, Homo sapiens
cgcactgtggagtccctgcaagtcagcaggaccagggctgtcttcctgcaccatctggatttggttagctctctctgggcagtggggccgagtctcatttcctccaacaataatgttatataggcaatgatcctgggctgccctaacataattgaaaattatgtgtattgtaggcttggagtgctgaaatgtgggctcataaaaatatgtggtgcacgtagcctatggagattggatgtggcacacaatgaagctttatgtaaagtaagaactataagtctccatgttaatattgtattatgagtatgacagttcttgggtgggtcctcagggcaggtctgtcaccttcaacaaagcccgagtttcctaattctacagagctggtatttggatgtaatcaaatcggttttgcaggtggccaaagatgaaaacttgtccaccaatccagctctccccactgagggatagcatgggatgtagatgggtttgactccatttggcatttttgttcacgggtttttatg

SEQ ID NO: 8783 - DNA, 553 bp, Homo sapiens
  misc_feature 51: n = A,T,C or G
ggcacgaggctggaggctgtcagaaggatgctgggggtgaagacaccctgnggtcctgacaaccattgggagtgtctggtgctcctgggtgagagagagggccagttggaaaagcctgcaggcccagccctggggcagaactgagtgtggcgggtgctgggcacaggatattcccccaggggcttagcttcatgcattcaggcttaccttgaggctccaagcttattggtggcataagctctgcagatccctcacctgccatcagcctcatctgaatctttgtctttcctcagataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatg

SEQ ID NO: 8784 - DNA, 318 bp, Homo sapiens
atcatagtctaaaactatcacgtctgagttgccttaggatgacagtgctgacacccagtaggaagtatcccatttttatcaggaaagtcagtcacgcgtagggatggtgaggagacgcgtatggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcacaagtgaggaaggcaaatactcagggtttgaagggagacct

SEQ ID NO: 8785 - DNA, 300 bp, Homo sapiens
cacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagcccaaggctctctgactgactccgtcccaga

SEQ ID NO: 8786 - DNA, 490 bp, Homo sapiens
gaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagt

SEQ ID NO: 8787 - DNA, 583 bp, Homo sapiens
gtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgt

SEQ ID NO: 8788 - DNA, 435 bp, Homo sapiens
ggcacgaggagtatttgctggtgcattggagagtttcacgtaattcttgtgcagattcagcaagagagtttgccggcatgctttgcacagcccctggtacccagtaaggcgattattagcattggtgcttgctggaatcagatattccagaatattctgtcacagctcatcgatgccctcttcttttctgtgggtaaactgaggcagaaactcaggctgggtggaactctgcagcctcagctggagacctcgtctggccaaggactgtggggacacaggccctctaggctgccacctcatggtcccagcagagggcaccagaactgcacagaaagtctcactacccaagtgtctgagccaggccagactgtgctagccagacctgcccggggttcattcactgacctatattgagcacctactgtatgcccagcc

SEQ ID NO: 8789 - DNA, 528 bp, Homo sapiens
ggcacgaggtcagaatggggaaagtggcaggatgcaggcaaacatgttcttaatttagagacagatgaaggctcaggactttcctaggcagataaaagaagaaagaagctgctttttgaaaagagggatcaagattaggacaaaaagggagattcagccatcagcagaacccaaatgagagcctacaaagagacactgtctactcagagtacatcttcagacatccagggtcccaagctactgtgtttactgttagcccttagccattgttaagtcttactgctttataactcttctttaagaatatattaatagtaaaattacttactcctatatatacaacgaatccttaattatcaaaaacatttatagtcatcacctcatgattcagtttgcccttctctagtccaaatgaattgaagtaggaattcataggaccgttcctagtgaagaaagattttagtgctatttaaagaaagtaaaaagtatattctcctctgatagaaattttcattctgataatatttt

SEQ ID NO: 8790 - DNA, 541 bp, Homo sapiens
aatatccagaatctacaatgaactcaaacaaatttacaagaaaaaaacaaacaaccccatcaaaaagtgggcgaaggacacgaacagacacttctcaaaagaagacatttatgcagccaaaaaacacatgaaaaaatgctcatcatcactggccatcagagaaatgcaaatcaaaaccacaatgagataccatctcacaccagttagaatggcaatcatagagcttttcatttatctgagtgttttcctctgcttgtcgggacttgtgctttcacgagctcctgctctcatatcaggggagtgaataattgaatttggatagttttttggtttttagttggaacactccttttcctgtggaacgtctatagaaaaaatgagtcaaacagagaatatgcaggggaggcaactctgaatgcttccatggctacatacatacctgttttctttgatttgctaaaccctaagttaaaaggaaagtactgtctaaaatagggagaaattccctatatttataccatcatttgagtatttacaatgg

SEQ ID NO: 8791 - DNA, 315 bp, Homo sapiens
gaaatgtcaaacacggacacctaggcagcatttacaagcaagagttcactgctttttcgatgtatatcttaagcgcccccagtgaatgaacagcatataactccacataaaaatcattaaatgtaattgacttccagagcaggcagttctgctgtatgcctctggagaaggctggctgaattggaattggtctgtaccttctgtctatcatgtacatgaggttcttgggcaaagagaactttccacaaaatatagtccaaaaattatagatcatcagacaaccaatagcatattgatgagatatctccaagatct

SEQ ID NO: 8792 - DNA, 535 bp, Homo sapiens
ggcacgagcttgcttgaaatacagaatgtccagatctactgagtcagaatttacattttcaaaagcttcctacgtgactcatgcatattaaagtttgggaagcactgacttagattaccttttgagaattccagatgggtcagaaaccagacagaaatactcagtagtgagaagctatggtgtatcagaagctgttaggcatttcatggtttggtagtgagcaagacagatagttttcctgtattcagcgacttagtctagagagagacaggatggaattaagtgtttaggtgctagccaaaagtaaagattcgtagaaaacaagggttcatatcccagtcatcaaagtgataaattttccctgcttaacatttagattaaaaagtaataattaggccaggtgtggtggctcacacctgtaatcccagcacttttggaggctgaggtggacagatcacttgagctcaggaattcgagaccagcctgggcaacatggtgaaaccccatctctacaaaaaataccaaagtcgggcac

SEQ ID NO: 8793 - DNA, 165 bp, Homo sapiens
ggcacgagaatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcat

SEQ ID NO: 8794 - DNA, 300 bp, Homo sapiens
cttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccat

SEQ ID NO: 8795 - DNA, 144 bp, Homo sapiens
aactgggattggtaatagtacagggctgttaggatgattgcatgagatgaaatacatttagcacttggtaagcactctataaatatggcaatatgatagtccctgactcatcttcctctctgttgccctttaaacaggtgagca

SEQ ID NO: 8796 - DNA, 81 bp, Homo sapiens
tttcttactcattaggctctagtctcacttcttattttttaaattgtgagtaattttcatgcttggtagttgatttctttt

SEQ ID NO: 8797 - DNA, 455 bp, Homo sapiens
ggcacgaggaccaaggagatgtgagtgaaaatgatgcaggctgcttccaggtgtgaccagtaagatacttcccacataatcttcctactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaaatactagcaaatttttaagaaggaagtaattccagtatttcacaaacccttccaaagaatagtaaaaacaaagagctttcctttcctcgttatctaaaattagcctaactttgatagcacaaccagctaggagagttgcaaagataataatcagaagccagtctcactgaacataaatgtgaaagtcttcagcacaatattagtctacttcgt

SEQ ID NO: 8798 - DNA, 335 bp, Homo sapiens
ggcacgagcactcttttatattagggacttgagcatctggagagtgtggtatctgagggagttcctggaactaatgtgcagatgccaagggacaactgtactattgtacttggaagtactcatggggtcatattgcattgtttctttgagtcctaattctgccaacatggcctggtgcttgcattaatcagctttctaatctctgagtaacaaggcacagtaacaaggagcagtaacaaggcacagggctggcacctgagagtggaggtacccaggaggcagacaccataaggcgggaaatggacatatgtacagaatcatggctgcatgtcctg

SEQ ID NO: 8799 - DNA, 92 bp, Homo sapiens
gtcccggagacccagccgcctgacagtgaagtatgaccggggccagctccagcgctggctggagatggagcaatgggtggatgctcaagttc

SEQ ID NO: 8800 - DNA, 351 bp, Homo sapiens
caagatcaagatttttttcctaaagagccatttgtcttattttagcttcaagccaagccagggcatctgagaaataccaagcctccgttgtgatgtgtcgccatgaaaatgttggctgccctctggatgcaagtctgcttgtgctgtgctgtggctcagagttaaatttagataaaaatcagttaggagctaaaaatattcccagctttcctgacaggttgtatccatcatcatgggaggaaaaacaaggaactggctgcctggcgacagggagcgggccaggctgagtgtgaggtcaggcctcggctggaatctcacggactttgaaggacagagacgttttctgagatg

SEQ ID NO: 8801 - DNA, 236 bp, Homo sapiens
  misc_feature 110: n = A,T,C or G
catcttcttcatccccctcctgcctttggggtgcaagtttcctgaaggacttgagtgagatgtcaccaagcaacaggctgtcaggctcttggcagcaagtactggcccancgactcgcggcagaatctctccttggggcgtctgtccttatcaggggtggatgctgtcagacttgctaatggtggaatttctggcatgtggcagggccaagtgcagtggctcacacctataatccc

SEQ ID NO: 8802 - DNA, 332 bp, Homo sapiens
gtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcgctttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccg

SEQ ID NO: 8803 - DNA, 387 bp, Homo sapiens
  misc_feature 387: n = A,T,C or G
ggcacgagaaggatctgtctgtgtgtcatggagcacctggagtgttctgtctggaatgctggctgggagccttctcctggcatttgaacgaggggcagctgtgtcctctgtttgccgtgtaaagaaaagaggacagagctcagaggagatgaaccccagcagaaaggggtgcttgaccagcaggagagaagataaccaagagggtctgtgggtgtctcttctgagctacaccagtttccaggttacctgggaccatggataactctcagatcagcaacttgtcagttgatttccaagctgctgttggctggactcagactcagcagggagcacctgggcgagccctgtgctgcgggctggactccggcccatctcgctgattactcn

SEQ ID NO: 8804 - DNA, 422 bp, Homo sapiens
gccaacatcacatcattgactcttcctgagcttatgaacaaataaaaccgcaggtctccttcacaagaagctgactgctaaatatggtctgccctggtctgtgatttttaaatgagaatctatagttctggcctgaatttctatatttctcatgaaaggtttgtgattatcaaacacaccatagtatgaaatcatcagaatatttaaaatgaagccctatgcaagtatgaaataccttatcatttaaatatatagactgtacactgacaggatgtctctggcattaaatgtcttttatgattatcgttacatgttttattgttattgttacatgttttaatgggttttttttttaactttttaaaaaatatgccttttaaagtatgttaaggctggctgcagtggctcatgcctgtaatccc

SEQ ID NO: 8805 - DNA, 465 bp, Homo sapiens
caagaacctgggtgccgagagggcaagggcttggatgctgctgtggggcctgcgcaaagtctgctctcatcagaaaggagcgaccagctgtttccagcatttgttccctccagttccagcactcacctgctcacacgctccctctcgcgaagagtggccagcagcgggctgagtgaaatgcgccactccagttcccacctacaaagcatgtcaaggtcaagggaacaatcccgtctcaatttgttgcagtagatattgctcttggttttgagtatcggtatgaaggaatggacttaaacagaggaatgtgttttcttccgttgctatttgtgttcttattgatgctcaagtggtcacattttcagcaagaggcagccttagcaatgtaacatgaatgatggctttgatttacgtagtgatgaaagtgatgtgtggttgtgtagacatcatctatgatgatctcat

SEQ ID NO: 8806 - DNA, 174 bp, Homo sapiens
ggcacctactccattggcaccgtgggcacccaagatgttgactgtgacttcatcgacttcacttatgtgcgtgtctcttctgaagaactggataatgccctgcgcaaggctgttggggagttcaacgatgcactgcgcaactctggtggcgatgggctggggcagatgtccttg

SEQ ID NO: 8807 - DNA, 399 bp, Homo sapiens
  misc_feature 399: n = A,T,C or G
tatctgctgtaatatttttatctgaggtagggataaaaacatcccatttctggactttacttggagaaccagctagaggtgaatatacgacccttcatgacctggactgaaaacattttcaagttctctatttcggtcaatacagcccctttaataattccccaaagcatctcccctttccacctgtgctacgactctcttgcacacgttttgtattcccacagatcacaaaatcacaaagcaccggagctggaagaatcttaagagataatccaaggccaggagcggtggctcacgcctgtaatcccaccactttgggaggccaaggcgggtgggattacctgaggtcaggagttcaagaccagcctggccaacatggtgaaaacccgtctctactan

SEQ ID NO: 8808 - DNA, 470 bp, Homo sapiens
gatccagaatacatttccaacaagagcactggccaagtcagcttcttctgagagagtctctagaagacatgatactacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctgga

SEQ ID NO: 8809 - DNA, 400 bp, Homo sapiens
cctccaccccatgtcattgagagcaaagcccaaagcccttaccgtggccaacaagactccatgtgttttcactctgcctagcccacctctttgccctcatctactactttctccaggctctctcatctccagcctctggtctctctgcagctccccagaccttccaggaatgtccctactctggggcctttgccctggctgcccgctttgctgaaagcatccttctgcagacatccacacacatgccccctcaactcctcccggaacatccacacacatgcccctcacctcctcctggtacatccacatgtgtacccctcactttctccctcacctcctcccagtacatccacacacatgcccctcaccttctcccggtacgtgcacacacgtgcccctc

SEQ ID NO: 8810 - DNA, 396 bp, Homo sapiens
gttggaagatcctgtggttcattcctttcaggcagaggcaaccactgcgagttccctaccactttgccaatcatgtctaaacagatggatggtgggcacagatgggtcctccatgctggcaatgcgttacaggttttatgataatagaactatgacagtcttcaagtcaattaaaatccacccaccaatcttaggcatcataatgtgccccaggctttattttaatagtgatcttgatcctgttgtgggactaatacatatctatatttaagttttaaagcatgtttactttcaaattagctttccacagggatttcttgaaatgcttttgttattaaactcaaaaggcagtgattaggatgaaataattgtacgtaatttattttagtactgaca

SEQ ID NO: 8811 - DNA, 475 bp, Homo sapiens
ggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgta

SEQ ID NO: 8812 - DNA, 451 bp, Homo sapiens
gtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatact

SEQ ID NO: 8813 - DNA, 561 bp, Homo sapiens
ctcatctttctcttatgagagaatgttaaatgggttttttgctcctgtcctggaattcaagctaagacctgaaatgctaaatgtaatcagacaaccatcctttctagcctcttggttcatataagaagagggaaaaagatcagtcctgatgacaggctagttcctcctttcctgtttgaagtcagagaatgaggagaaaggaatggagatagaaaagcagagagaaagactgacatttcatgattagccagggcaatttcttttttgttttattttataatggctgctcagtaaggatagcctcagcttactgatgttgttagaaagtgacaattcttgccttgcagaaggattactctgcattgatctggcactttggcctcagtttgaaatagaatttgcctgcagctacattagcataataaaacacagcaaattcacagtctctttctggcacttttcctgcagtatttgtagaatactagaaactattttttacacattagttatacttgcctaaaaatcttcagaccatcatcaatctacagagatctgagagaa

SEQ ID NO: 8814 - DNA, 499 bp, Homo sapiens
gtgcggctatggagacccaggggcagcccaagtccttttgaaccaagcagggaggggttttcagggtctttccagtgacccaagggaggaagggctgcgctgagatgtgccactttcaggcagagagagagagaaagatctgggggtgaggggtactagacctctggatcgggtgtcatcggctcgctccttggcatagtttcagacccgattttctggctgactttcagaactacagtattgctcaaactctgctgtgctcagagcctcgtaggagaactggtgagaatgcagatgcccaggccctaaccctggagattctaattcacaaggctagggaggtggcctaggtacctgcattttaaaaatacccgccttccccttcctagagatactaatgcaggtggtcctgggaaaacactcttggaaaaacacgtgatgtggaagatagaccctgtggcctctgttcccttgatctagcacattcctggtcatgtca

SEQ ID NO: 8815 - DNA, 362 bp, Homo sapiens
tgtggtacattcagacattgaaatattacccactgctaaaaagaaatgtgctattaagctatgaaaagaacatggagaaaaatgcattttactaagtgagagaagccaatctgaaaaggctacatagtatatgattccaagtacagttgactcttgaacaatacaggtttgaactgcatagatctacttatacagggattttttttcagtacatacagttggccctctgtgtctgtgggttctgcctctgcaatgaaacatggatagaaaattcagtattagcctgggcaacaaaatgagaacctgtctctacaaaaaatttaaaaatttagctgggcgcagtggctcacacctgtaatcgc

SEQ ID NO: 8816 - DNA, 548 bp, Homo sapiens
taatgtaggccagggtcagaatttgaactgttgaaagagggcaactttgaagaaatttttaagggataaaattgatcacaatttcttgaacaatggatactttttatagaactgaaaaccaaagaactcccagcttccactaagaggactacacaaatctgggggcatacgctaggaaaataaatgggatagagaaaaattacgaaggcactagaaatggaacgtctgggacagtaaagaggtccatattaaaaagtaagttgaaggccgagtgcggtggctcatgcctgtaatcccagcactttgggaggccgaggcgggtggatcacgaggtcaggagatagagaccaacctggctaacacggtgaaaacctgtctctactaaaaatacaaaaaaattagcagggcctggtggcacacacctgtagtcccagctactcggcaggttgaggcaggcgaatcacttgaacccgggaggcagaggttgcagtgagctgagattgctccactgcactccagcctgggaaacagagctagattctgtctcc

SEQ ID NO: 8817 - DNA, 402 bp, Homo sapiens
gaagacgacagaagggtacggctgcgagaagacgacagaagggtacgggtgggagaagacgacagaagggtacggccgcgagaagacgacagaagggtacggctgcgagaagacgacagaagggtacggctgcgagaagacgacagaagggcacgcctgtaatccccgcactttgggaggctgaggtgggcggatcacttgaggtcaggagtttgagaccagcctggctaacatggtgaaacccgcatctccactaaaaatacaaaattagctgggtgttgtggtgggtgcctgtaatcccagctactcgggaggctgaggcaggggaatcctttgaacccgcgaggtggagtttgcagtgagccaagatcgcgccattacactccagcctgggcaacaaga

SEQ ID NO: 8818 - DNA, 618 bp, Homo sapiens
gatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttact

SEQ ID NO: 8819 - DNA, 540 bp, Homo sapiens
gctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaagaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcata

SEQ ID NO: 8820 - DNA, 569 bp, Homo sapiens
aggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgagatcagccctgaactcactgtgtattctcttggagc

SEQ ID NO: 8821 - DNA, 195 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggc

SEQ ID NO: 8822 - DNA, 131 bp, Homo sapiens
gggctgactctcttttcggacttagcccgcctgcacccaggtgaaataaacagccttgttgctcacacaaagcctatttggtggtctcctcacatggacgtgcatgacattgggtgctgaaacccgggaca

SEQ ID NO: 8823 - DNA, 154 bp, Homo sapiens
  misc_feature 28, 30, 31, 32, 34, 40: n = A,T,C or G
gattcttgtccccccagctggagaatantnnngnaatttntttagaaaggaaagtttgtttttcacagcgatggggtaatgcagcctaagccttctgactgtctgcgaatgcttgtgcctgccgccgcgctggccttattgttcgctattcagg

SEQ ID NO: 8824 - DNA, 367 bp, Homo sapiens
cggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcgggggggcttgtgtgttttgttggcttgtttgccatgaaggtagatgtgggtggggagaagacacaaggcagtttgttctggct

SEQ ID NO: 8825 - DNA, 211 bp, Homo sapiens
cccccagtggagaagtgagtgggggtctccagctaggaaggaaagggtgggaggtggagagcagccccagggggcagtcactaagccccatgcagggcagaatgccaggaacacaggctccacggggcccagacaccatccctcgccaagcaagacacaggctgtgctgcagccatctccacggggcctggggtttcctgggggctctgtg

SEQ ID NO: 8826 - DNA, 142 bp, Homo sapiens
aaatgttatactttatggatataaaggtgataaagattggaaataggtcttctaaatatgtaaaatgaaagcaacagcaacaacacacacaattatcgtattctttgggagtaacaaatactggttttcattttaaaactaa

SEQ ID NO: 8827 - DNA, 150 bp, Homo sapiens
gccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaag

SEQ ID NO: 8828 - DNA, 467 bp, Homo sapiens
tccgttgctgtcgggactacaggtgcccgccaccacacccggctaatctttgtattacaggatagagttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtgtcagccatgacgggtggggagtggcctgctgctcctcctgggaagagaagaaggtgaagactcagggcgcgtctgcagggagacagtgggagctgtggggtcgtggatgacgctgatcctgtcattagcatctgagcgaggtcacaggcatgtggggcctcgttaacaat

SEQ ID NO: 8829 - DNA, 425 bp, Homo sapiens
gttagtagagaaatagacaagagcacaggtaattacaatacagcatgacaagtgttatgataggtcaaataaagggcactattggaactgttctcaataaaaatgcaacataactgctgtctgagtgatttattgctcttgattataaaatatgcttgcaagatagaagctaactcctactcatccttcaaaaggcagctcaaattgtcatgtacccacatcctccagtgaattttcctttccaccccactaccctgccccttacacttgagattaggatccttttcatgtgtgtccatcaaactttatctatttgtattacagtacttctcacatgcattccaatgatctattcaaatgtctgtcactctgctatactctaaactcttggagggcaaggactccatcttatttgtttttgcaat

SEQ ID NO: 8830 - DNA, 215 bp, Homo sapiens
gagtctccggcgggttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctga

SEQ ID NO: 8831 - DNA, 379 bp, Homo sapiens
aatcactgtcttaatctttctccttccaatccttcctgcctgtcctgcctgagtaacttttcaaaacttccagttaatcaataaaggcttctcattgcctttcttcaggttggctttcacattctgccccaggccactctcttgcccttgttttcttcaatttcttccatgcctatattagtccatttgtactgccataaagaaatacctgaggctgggtaatttataaagaaaagagatttatttgtctcatggttccgcaggctgtacaagaagcatggcattggcatttgcttctggtaaagacctcaggaagtttccaatcatgtcagaaggtggagggggtacaggcacatcacatggctagaatgggactcaa

SEQ ID NO: 8832 - DNA, 534 bp, Homo sapiens
ccgttgctgtcgctctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccaccaggaggggtctctgtctcccaggtagaggaattctccatggtgagaggtggtggtgggggatggtctagctgtccactcttgccccctttcggatttggaaggaagccccatgctgggtccacactggtatggcgtattaattaggcagctgctttgtctgggagggggctttgtgtcgagtctccctgaatgagcagggctggcgacagttgtcaaaacacatggtgcttggtcag

SEQ ID NO: 8833 - DNA, 619 bp, Homo sapiens
  misc_feature 301, 382, 387, 412, 492, 524, 606, 619: n = A,T,C or G
actgtaagatacagaattgccgctgggcatggtggctcacgcctgtaatcccagtactttgggaggctgaggcgggcggatcacgaggtcagttcaagaccagcctgaccaacatggtgaaaccccgtctctactaaagatacaaaaaagttagctgggcatggtggcacgtgcctgtaattcgagctactcaggaggctgaggcaggataattgcttgacctcgggaggcagaggttgcagtgagcagagatcgcaccactgcactccagcctggatgacagagcgagactccgtctcanaacaaaacaaaacaaaaacagaattgccttctcagtaaaggaggaaataacatttataataactatcactttagtgatagntattntaaatctttgaaaaatggacacttncaaattaccgtgctcattataaattgagaaatacggttctattaataatattctgctaggccaggcagggtggctcacancctgtatcccagcacttgggagggcgaggtangcaaatgacttgaggtcagggagtcgagaccagtctggcccacatcatgaaacccctactaaaatacaaaaaatagctgggngggggggcatgcn

SEQ ID NO: 8834 - DNA, 159 bp, Homo sapiens
atgccattttcagcctcagcacgcctgcacccaggcgctcattaaaacagcatgttgctccccactgcctcgtgttgtctgttggcgcgctgtcggggttcgaaccgatacaagaaccttccacctacctggtgctttggcctcatctataagcttttc

SEQ ID NO: 8835 - DNA, 341 bp, Homo sapiens
agttaaattacacaactctgcagatgtttaaccaccgtaagacaatatactactttttgtgcgtgtgtgtatgtgaaacagagtctcagtctgtctcccaggctggagtatagtggcacgatctcggctcactgcaacctctgccttctgggttcaagcaattctcctgcctcagcctcccgtgtagctgggactgcaggtgtgtgccaccatgcccagctaatttttttttgtatttttagtaaaaacaggttttcaccatggtggccaggctgatctcgaactcttgacctcaggcaatttgcctgccttggcctcccaaagtgctgggattacaggcg

SEQ ID NO: 8836 - DNA, 354 bp, Homo sapiens
caatgctaagtgctaaggatgtgaagataaatctctgctctactgaatttcagtctagtgggagagagagagacaagtaaatagtctatttctttactatatgttaagttatccaatagaggtagataccaagttttgtgggagcacaaacttcactgttgtcagtgaaggattcctagaggaagtgtatcctggggtgagtcctgaggaataagtaagagtagcaagttaggattattcatagaattttactccatcttctgtgaagatggagaatacataccaaattgtggaggcaaaagaaagcatggcatggtctgaggaaaataggataattagggtagaagcaggtaa

SEQ ID NO: 8837 - DNA, 538 bp, Homo sapiens
tcgtggcagagacgcctagaggctggcgcccagggcaggcaggacccaggtgcctcccattcttgtgcttggctgcccttggtgacagctccaggcagtggctcttgaggaaagaggggtgggaaaaggggaaccctcctgcccaaatcaggctctttaaggaggcttctggaagtctccactacttccagtggtgtagccatgaccagctgtccatgtctcagcctgtttgcctcccaaataaaacaggggccttggctgggcacggtggctcatgcctgtaatcccagcactttgggaggttgagacaggtagatcatttgaggtcaggagttcgagaccagcctggcccacatggtgaaaccctgtctctactaaaaatacaaaaattagccaggccataatggtgtgcacctgtaatctcagctacttgggaggctgaggcaggagaatctcttgagcctgggaggcagaggttgcggtgagccgagatcatgccactgcactccagtctgggcgagagagtgagaccctgtct

SEQ ID NO: 8838 - DNA, 457 bp, Homo sapiens
ttgtaaaagagttcttgagatacagcactgaatgtaaaggaaaatattggagcattcaactacatttgagaaataacttctgtttattaaaagatactataagaatgaaagcacaagccctaatgaatattcttgtttgatactaaaccaaagcttgagaagtggtagtttcgcaagtttttcaagtggtttggtgcaatctgaagactgcaatcccatcaatgaactttatatctttaccctttaaaattataatttatgggccgggcgcagtggtttacgcctgtaatcccagcacttcgggaggctgaagcgggtggatcacgaggtcaggagctcaagaccagcatggccaagattgtgaaaccccgtctctactaaaaatacaaaaatcagccgggcatggtagcaggcacctgcagtcccatctacgggggaggccgagacagagaatcgc

SEQ ID NO: 8839 - DNA, 574 bp, Homo sapiens
ggaattaaatatctgtgaaggagcaaaattacagtaataattgcttctggccttaatgttgggctaggatagcttgttggataagtcaggaatgcctataaaaataccagttcttggctgggtgtagtggcttacacctataatcccagcgctttgagaggaggccaagctgggaaaattatttgagcccaggagttcaagaccagcctgagcaacatagtgagaccctgtctctaaaaataaaaataaaaacattagccaggcatggtggctcattcctgtagtcacagctactcaagaggctcaggcaggaggatcacttgagcccaggaagttgaggctacagtgtgctgtgattgcaccactgcattccagcctgggcaacagagcgagatcctgtctctaaaaataaaaataaaaaaagtagccaggcatggtggctcatgcttgtagtcacagctactcaagaggctgaggcaggaagatcacttgagcccaggaagttgaggctgcagtgtgccgtgatcactccactgccttccagcctgggcaacagagcaagaacctgtctcta

SEQ ID NO: 8840 - DNA, 320 bp, Homo sapiens
actgtggatctgtccccaggtttggctgggggtttggtttttagtagagatgaagtctcactatgttctcaaactcctgggctcaagtgatcctcccaccttggccccctaaagtgctaggattataggtgtgagccactgcatttgggcgccgtgaaaagctttgagaaggctaacggaaaagcaagggagagccctgggcacacagccccctcgaggaggcaggtagggccccacctcacggtgtgggtcacagagctttactccctgcatttccagccatgtgggtttgggggccatccacccatcagatactggtt

SEQ ID NO: 8841 - DNA, 572 bp, Homo sapiens
tatggtatgggagaaagagagagaaagagggcaacacgcgcacacacacacacacacacacacacacacacaaacacacacacacacccccctgcatgtaacccagctgaaaaagatctgaatcagccagtggttatgagagggacgaagattggggtatgggggtgtcacaggggacttttttttctttttctctcacatctctgctgggaggaacttttgccttttctttagttgtgtcttctattttgttttctcaggaactggctcagcacagtattttcttaagataggttcttgctttgtcaccgaggctggagtgcagtggtgcaaccatagctcactgcagcctcaatcttgtgggctccagtgatcctcccacctcagactcctgagtagctgggcatggtggcttacacttgtaatcccagcacattgggaggctgagatgggtggatcacttgaggtcaggagtttgagaccagcctagtcaacatggcgaaacccagtctctaccaaaaatacaaaaattagcccagcgtggtggcagatgcctgtaatcccagctactt

SEQ ID NO: 8842 - DNA, 437 bp, Homo sapiens
gctgggcagggttaaagtaaggtaaaatagagatcaggcctgcagaatccctgcgaagacaaaaccacttagtgaactcaacctttcttgatttgcaaacctaaggaaaacttaacttgagctaactcttacaaatgcctgtattacagaaaaacagagcttaagctcaaccaatcagaggtagccaacaaactttcataattaggaaccttcataggagatcaatcaaataaggcaattgtgtaattatatccaatcaaatgtttgctttgctttacctctgtttctgtcttataaaggcctccccatagattcccttggtggagttcctgaaccacttctggtttaaagctgtcaagtccatgaaatgttgtttgctcaaataaactctattaaaatgtttattgtgctcccatttacctctttagcagcagtaa

SEQ ID NO: 8843 - DNA, 571 bp, Homo sapiens
gattcaagtgattctcctgtctcagcctgttgaatggctgggattacaggcacgtgccaccatgcccagctaatttttgtatttttagtagagacagggtttcaccatgttggccaggctggtctcgaactcctcacctcgtgatctgcccatctcggccccccaagtagctgggattacaggcaccggctatcacacccagctaatttttgtgtttttagtagagacggagtttcaatatgttgaccaagctgttctcgaactcctaacctcaagtaatccacctgcctgggcctcccaaagtgctaggattgtaggtttgagccactgcactcagcttcattctagcttttaatataaaagatatttttcaaaagtaccattagtgactcttttaagtaatgggaggaataaggtcattagaaaccatttaccaaccaaaatatttgtgataggctttgttttgagccctttgaaccctaaatgaagttctctatactatctaggggtgaaaaaagttgtttttaaattctgcttcatttctaataaattagaaaattcaaagcaaaaa

SEQ ID NO: 8844 - DNA, 351 bp, Homo sapiens
tcagcatacaaccctagatgatcttgtcgtgaagatgaaggagatcacagacaacatcttgccagggtctgagttttaatgctggcgttttagatatcctgttgggctacaaaaacatgtcaggcaagatgttaagttttgtttaaagcatcaagaattccaggcccggcgcggtggctcacgactgtaatcccagcactttgggaggcctaggcgggcggatcacgaggtcaagaggtcgagaccatcctggttaacacggtgaaaccccgtctgtactaaatatacaaaaaatttgccggccgtggtagcgggcgcctgttgtcccagctacttgggaggctgacgcag

SEQ ID NO: 8845 - DNA, 588 bp, Homo sapiens
ggcacgagaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacag

SEQ ID NO: 8846 - DNA, 300 bp, Homo sapiens
ttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgc

SEQ ID NO: 8847 - DNA, 319 bp, Homo sapiens
ctaattgcagtagttaattgtaacaagcccttcggtgatcctgaaacatgttacagtttgagaaacactgctataatacgtgtcatttaaattgtttcaggttgtgggggtagggaataagactaccaatttattcatcttctgtgcaatattacctgtttacctaactcttagagatattaacacattttgaagaatgtgtcccatgagattataatggaactgacaaattcctattgcttagtgatctcatagctgtcatgaagtcttagtgctgtaccttactcatgtgtatgcggtggcgatggtgtacacaaat

SEQ ID NO: 8848 - DNA, 452 bp, Homo sapiens
tctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactacacgtgcattctggaagcattagaccccaggatggagcgaccagcatgtcatccatgtggaatcttggtggctttgaggacattctggaaaatgccact

SEQ ID NO: 8849 - DNA, 280 bp, Homo sapiens
cgaattcggcacgaggtccatctttgtagctgacatgacacattttaaaaatgtcacattaaaatgaacgcatctaatggctccattatgtcttttagagtggtctggcccagctaattgcatattgaaatacattagatttgtcataaattactttcctttattgtcttttctgtcaatcttaggacattaaatgtatatgtttgaaattgtgtttaggtaggttatctgagcatttggttcatatagtaaagagagcgttataagttcactgtaagcc

SEQ ID NO: 8850 - DNA, 410 bp, Homo sapiens
ggcacgaggggtgcttctgtatatcctgacaacagtggccagccattaaagagttttgagtaggggaactggatttgtggttttagaaagatcatttggcttctgtgtgaaagaggccaaaaccaggagcagaaagaccagttaggaagctgtgacagcagttgagagacgatgttgtcaaagtctgcagcagaacagaacaggggtgaccccacatggacatcatctctgctcttcagtcacctgtagtgcagagttttgaagtaggtctgagcatggaaccgtagtggttgggaaggaaatgccatttgcctatggggtgattaagatctttttttttttcctcaggcggagtctcgctctgtcccccaggctggagtgccgtgacgtgatatcagctcactgcagcc

SEQ ID NO: 8851 - DNA, 580 bp, Homo sapiens
aaatgatcaagggaaacatttcatagtccttaatctttctagtataaaacatcaaacaaatttcatgtagaatatctcttggtagctattaatattgtgaaattgtctttgttttaaacacattcacacattatgattaatgtattttaagcatatttatgtgagccatctttacaaattcaataattccttttctagtaaacactaaaacctattaaatcaataacattgatttatgtatatatatattgattcataacctaaatatatttatattttatacacatttatttgcatgctgtaaaatataaaatttagatatatttttctgtaacttaataggtatcttggcaattcagaaaacaaatttccgctccagagctgctctgactcaggcatctgtttcctttaggtgtctggttgagaaagtactcagagggtagaggatacttgagcagggtagagacccattagacaattttgtgtggaggtcaatacaggaggtaaattgtctactttggttagaaggtgcctggtttattcactgagacttgattacaacaaaagatagagtcacaca

SEQ ID NO: 8852 - DNA, 489 bp, Homo sapiens
tcacggcaacctctacctcccaggttcaagcaattctctgcctcagccttctgagtagctgagattacaggctactaccaccatatctggctaatttttgtatttttagtagagacggggtttcaccatgttggccaggctagtcttgaactcctgacgtcgtgatccacccacctcagctccccaaagtgctgggattacaggcttaagccaccgcacctggcctaaagataggctatcatccagaaaaatatactgtgatctaatgttaaaaataagttaaaactacctcaagctagtagtttgcacagtgtctgacaaatgttactgtgttttcctcaaaaatttaaaacatcagacagtcctcgtgtgaattcactgcagcatactgggtgccttggtgcacagtttggaaattgaggcacaagaattaacgtttcttgatgtcatgaaatataccatgtccaggccaggcgcagtggctcacac

SEQ ID NO: 8853 - DNA, 476 bp, Homo sapiens
  misc_feature 396: n = A,T,C or G
aatctcttcctcaccagccaggatggaacagtgtctgcctttcttcattccctgctgaacctcttgcagctgcacttgttttcttctctgacctggttcttgtctccatgagtcctgggtggagtgccagatcaagcccctgctgtaggctaggtgcggtggctcacacctgtaattccaacactttgggaggccaaggcaggaggatttcttgagcccagtagttcaaaactagcctggtaggccaggtgtggtggctcacacctataattccagcactttgggagactaaggcaggtggatcacctggggtcaggagttcaagaccagcccggccaacatggcaaaaccctgtctctactaaaaataaaaaaattagccaggcatggtggcggnggcctgtaatcccagctactagagaggctgaggtaggagaattgcttgaacccaggaggcagcagcctcagtgagccgag

SEQ ID NO: 8854 - DNA, 649 bp, Homo sapiens
actatctcggctcactgcaagctccgcctcctgggttcaggccattctcctgcctcagcctcctgagtagctgggactacaggcgcccgccaccgcgcccagctaatttgttgtatttttagtagagatggggtttcaccgtgttagccaggatggtctcgatctcctgacctcgtgatccacccgcctcggcctcccaaagtgttgggactacaggcgtgagccaccgcgcccggccaacaatcttaaggctgatttcctctctccccttcccttacttctgctgggctgcaagcaagattgcccacccttggctaaaggcatatgtactcttggattagaagaagggcagattcctagctagctactgatgaccaaaaagaataggaagcactgctggtagaagaccattactgacaaatctttcctggcggtacattcaaaccttgccccacaagggcattctgacagtatttaacaacatttgtattgcaaataactccttttgacttagtgacttcacttctaggtatgtatcctaatagtaatgctcacacatattctttcagaaagatgaatctgacaagattgcagcacctctaaataaagaaaaattagaagccagctaaatgtccaccagagaaaagct

SEQ ID NO: 8855 - DNA, 77 bp, Homo sapiens
aaaccatacacatatctgtaagtggcagtatacacatttctttcaaacataagtgaaacacttataaaaactgatca

SEQ ID NO: 8856 - DNA, 513 bp, Homo sapiens
  misc_feature 260: n = A,T,C or G
gcaaacaaaattaaatagcttattaaaagggttatacaccataagcaattgagatttatttttagcattcaaggatgtttcatcacaagaaaaccaaactatataatacactacattaacagaatgaagggaaagcacacaacgcatgcacacacagacacgtaaatgcacacacacgcaaggccatctcaattatggcagaaaagcatttgataaggtgtagtgctctcttagggggatatggctatgaggaaaagtanggtgagtgtgtgtgtgtgtgtgtgttattaagggcagatgtaaaaatgtatctttttatatttgggaagaaaactgacaaataaagctaacaaatcaacaccattgatgtgttatctagagacacaaatataaacacagtagtaactggaaagaagacagacaacgttggcccagtacatgcaggagatagatgtggtgggagcttatggaagttcccctgtaaggaatagcaagcaattcttcagctgatat

SEQ ID NO: 8857 - DNA, 507 bp, Homo sapiens
tatggtcagattctggcgggggtcccttttctgatttgcaaatggccttctttttgttgtattctcacacagtggggaacagagagaggggggaagctctcctgtttcttcttgtgacagcactaatcccattcataaggcctccatcctcgtgatgtactcaccttccaaaggccccacctcctaattccatcacattgtgggtgatttccacatatttcaacatacaagtttaagagaaacacaaacattcagtccataacataatctgtctgtggctatactgctctaaataataagtaaacaatgtagctagtttaacttgtcccaaaactggttattccattggatgagtttgtttggaccccttatgtgggaagtggacaagggttaagtttgcaattatgatcttaacatcatcttccttcttttaacttctgttaagattaagtatgaaaatacattcaaaaccaggatatctacactgaatagcattttttatgtagt

SEQ ID NO: 8858 - DNA, 415 bp, Homo sapiens
ataccgctgctatacgactacctgcaattaaagcctgataaataccatggggggtttttttacttgaacacttacagtgcattttcctttaggaattgggcatcccctgctagctagtgtttcaacctaactatcaaagcttattgaattcaaaatgtagctgatctataaattacaaaaactctattctacagtcctacaagagagtctacagaaaacaatgccttcttaatcctaaatttgaaagttaagcctgggtacagtggttcacacctgtaatctcagcactttgggaggttgagacaggcagatcatgaggtcaggagatccagaccatcctgtccaacatggtgaaaccctgtctctactaaaaatacaaacattagctgggcatggtggcacgtgcctgtaaacc

SEQ ID NO: 8859 - DNA, 505 bp, Homo sapiens
gacagatgtacatgataatacatatggaggcagttcttatattacaacaataagcaacgcttgctatataaataactgctgctactacatatcgtataactatacaatacccatataacatgcattgcacgatcttccctgaataactcaattatgcacctgctacttactagcggattggaggtataattaaggagacctaagacataatctgtatgttgtaaaatataaacgcataaacagagcagaaaatacgagatcattcatagaaaagtcaatgttttaaatacactcatttaaagaaattattcaaatttgcctttagcttcacagctgtaagtactaaacagacaaatgtgtttcttggagttacaactgtaggagcacagcatcaatctgtgaagctgagagagacaatgagtgaggattcaacaaatacctctagtcttttaacttcttgtgaagcagaatgattgaaaacaactaggctaacttaattctatag

SEQ ID NO: 8860 - DNA, 500 bp, Homo sapiens
gtgcatggagacaggaatgaagccagaacgcaggtggggtgagccgcatggcaggatgatggagctcagtccggctgagaagtgtgttcgttagcatcctgcaggagtcctcaaggtcattcgacaattggtgcttcattcatcggctcaataaatatacatgagcacttacacagttcctggtacaatgaacataaaagctaaaatccgtagcctgggccgggcgcggtggagctcacgcctgtaatcccagcactttgggaagccaaggcgggcggattacctgaggtcaggggttcgagacaagcctggccaacacagtgaaaccccatctctactgaaaatacaaaaactagctgggcatggtggtgcatgcctgtaatcccagctactcgggaggctgaggcacgagaatcgcttaaccccgggaggcagaggttgcggtgagctgagattgcaccactgcactccacctggacgacagagtgagactccgtctc

SEQ ID NO: 8861 - DNA, 514 bp, Homo sapiens
gaaagatttactgcttattcatctggaggcaatccttctcttaaaaaaataaacaaagcttgctatataaataactgctacttctacatattgtataagtatacaattcccatataacatgcattcaaagttcttccctcaattcctcaattttgcacctgctacttactagcggtttggaggtataattaaggagacctaagacataatctgtatgttgtaaaatataaacgcataaacagagcagaaaatacgagatcattcatagaaaagtcaatgttttaaatacactcatttaaagaaattattcaaatttgcctttagcttcacagctgtaagtactaaaaagacaaatgtgtttcttggagttacaactgtaggagcacagtatcaatctgtgaagctgagagagacaatgagtgaggattcaacaaatacctctagtcttttaacttcttgtgaagcagaatgattgaaaacaactaggctaacttaattctatagttttaattct

SEQ ID NO: 8862 - DNA, 123 bp, Homo sapiens
gctggtcttgaactcctgggctcaagcaatccgcacgcctcagtctcccaaagtgctgggattacaggcatgaaccacagcacctggcccacagacaaacttttaataacatgcaagaattca

SEQ ID NO: 8863 - DNA, 563 bp, Homo sapiens
tgtattgtcctgataaaatgtcctgaattctaataagtaaatgcttaagtcagtctttgctctggagaaacaaccctggtcccagcagtgtgctaaggccaacttgtaataagcttgcaaaattgattttaaaattttcaaataattttaaacttcccacttttttgacatcatgttgataacttgaaattggttatagtgggactatttacactatggaaatcagcagcctccactaattaggcccctcaaccactaggaaccagctgtgaaacactgaccaggacaccactgcctggctcacctattttctcagttaggattgcatactttgcatgttatttatcattagtaatctctatagagaatttaaataaaggaaaattgaacagtttgttcttaaaattttacttttgtaaacgtacttaaactattcacatccaattggaaattgagtctccaaagtatgtgtgcgtggtagttttcatttggtgttaaagaaattttgaagataatgaaaatgccactggagtggaagtcaaggaacttggatttgtcactga

SEQ ID NO: 8864 - DNA, 413 bp, Homo sapiens
tgggagggtggaacaaccatcccaccctacagaaacactgaacaccacccttagtgaatcaatgaagcctgaatgggaattgaacttttacctgcatctgtagtcccaaagaagtgcccctcctttcctggccccacctaaaacagaaagcttaaataatatttagttttataatacccaaatatccaggtttcaatggaaaatcatttatcacatcaaggaccaggaagatctcaactaaatctcaaaagaccatcaatagatgccaacaccaagatgacagaaatgtgagaatgatctgacaaggattttaaagccatcatcatacaactgcttcaaccagtgattacaagaatgcaacaagcaaatgaaatataagatataaacaagaacccatggatattttaaaattt

SEQ ID NO: 8865 - DNA, 531 bp, Homo sapiens
atatatgttttttgctgaacagtttgagattaatcagggtaaggagatgtcatgatgcttaccctctctctctatatatattttaaggcagggtctcactatgtcacccaggctggagggcagtggtgcaatcatagctcactgcagcctcgaacttctgggctcaactaatcctcccacctcagcctcccaagtagctggaactataggcacatgccaccacacctggctaattttaattttatttctatagagagaaatcttaccatgttgcccaggctggtctcagactcaagtgatcctcctgcctcagcctcccaagtattcagattataggcatgagccactgtgcctggcctaagttcttgagcatctgtttcctaatagtaagggcattctcgtacataaagacactaacatttcaaaatatgaaaaatgaacgataattttctcattatatctggtatccagtccatatttaaatttatctagttgtctccaaattgtcttttatggcgattttttcttcct

SEQ ID NO: 8866 - DNA, 604 bp, Homo sapiens
acctcctacctgaagggggctgctggctgtggggtcccgcttgtgcccgccacctccttctctgtcttctatgtcatgtgaggctggcattcccacgcgtgattccaggcttgttgttcatctacacaaaacttttaatacgattttgacaaaaaacatagaaaaggatgacttgccctactgaatattgaaatgaaccgtggactaactatgaactttcaaacaatccattagcggctgagaaataaacagaaaaatcaatggcccaacacagacagtggagaaacaggctgaggagcatgtccaagtttgtatggtcaggagtgtgcctttcaagtctgtggggaaatacgtgtggaaaagcaagacaggagtgtatttcataccacagggcagaaggattccagacttatgtggaaggaataaagtcatcacaatgtgagcttacatgggcctgtggggcaaaaggctttctaagtatgacttctaagggagaaatcataaaggaaatgcatgaataataaaaaaggatacattttctatggtaaaataatatcacagaaggaaaattgcaaactgtgaaaatatatttgcatcatatgtc

SEQ ID NO: 8867 - DNA, 652 bp, Homo sapiens
catgttagtaattctaaatctcagcgatccctgttgttccataacagtaccactgctggaaactttagcttatagtattgggtcaaaaggagaatgctgggtgcttcaaaataaaagagaagtttgcagtgattgtcattttatagccaagatgagacttaaagacttcctcaaagtagatactcaataagcatactttatttttattactgcactcacattaggttttataatactgtgatatttacaatgtatatttccaaaaataattttatgtgttttatttcatatacttctgagaatttctctgaaatatagaggcagatattattaggttggtgcaaaggtaattgtggtttctgcttttaaaggtaatggcaaatattacatttacttttgcaccaacctaatacatattcttcttagattttcttagtcccttattcatcctcctttagtatagagccaaatcatagccatagacatatccttatcacttaatcacatgatcagttagattgtaatgaaaaactcaagtaaataaatgtaattgagtacactaactcatagaaagaaatgttttgattaaggtcacactattttttaagaactaaaaaagccagacgttgattccagaagtacagacaccagc

SEQ ID NO: 8868 - DNA, 640 bp, Homo sapiens
agagccagaggtgacggcaacacggtatcagcaggctacatgagtggccacgtgtgcagctgttcagagaaagcctgtgcgctggggtggtgctgtgaagctgatcgaccaaagggatcaaaacccagcgttggacgcagcatctaaggagagaggttccttggccacatcctccacccaggcgccaaacagtgaagagaagccacgcatctgagagtcaccaaaggagcagttaactcacgctcagcccttgatcatccacactgaggggaactggctggccatcatcaaaagcgcatctctgccgctttgcaacacgagaagtcatctgccttagcagcaggctctcctcctgaagtaaggccccaaagatttcctgtgatccaggaaaggaaaacagtaaataagccagcttccgtgtcctcactgacggggggcagcctcagaaagcatctcttttctccaaatctccagacacttctccactctgagccaagtgctaacccaaacagttcatgactcaacagctacgtagtctatccacccattcatgtgacattgtgaaggcgacactgccacaagccacaaccaagccttctacagggatgaaggccaaggggactctatgcagggagcgcat

SEQ ID NO: 8869 - DNA, 601 bp, Homo sapiens
ctttggaaggccaatatgtgtggatcatatgagcccaggaattgagaccagtctgtgcaacatggcaaaaccttgtctctgcaaaaaaataaataaaatacaaaaatacaaaaattagccaggcatggtggcgtgcacctgtagttccagctactcaggaagctgaggtgggaggatggcttcagcctgggaggttcaaggctgcagtgagccatgattgtgccactgcactccagcctggatcataaagtgagaccctgtctaaaaaaaaagaaataaaaagaaaatggacaagtagacttagtagacatgggaaagctaaaaataggaggatgggggggaaaacagagaagcaatctgatttgttctacagagctcccccaaaggctcaaaaatggataggagtaaaggttatagccatggtgagagtccaaaggtagtaagttagtaagagggagccgatgacaaatgtggcgaagatagaaataacagtacttgattaagcttcaagagggcaatgatcatataactgcttaattcgtggtccctagatgcgcctatttcaactaaacatattgttgggtggatagatagaaagaag

SEQ ID NO: 8870 - DNA, 591 bp, Homo sapiens
ggacatcttaagtctctagctcagaaacaatgagatgtaaatttgagttgtccagaattgtatttatggccatctaggaaaattcttgggtaagttcgacatttcggcatgttgctgggattcttccagggtttgaccctaggagtatttgtagttgctcctgtcagtggtaatttagcaagcatggttggagagatgcagactgacatcttctgggatgttggcctcagtgagaattcgacatgatgaatattagatggtagagcagttggaatcagaggctgaagaatgggaccaatactgattccaatccccactcttggcctcatccatcaccatcatctccctgcccttttcttctccaaaataacgactagcaaaataaaactctggccgggtgtggttgctcacgcctataatcgcagcactttgggaggccaaggcgggcggatcacgaggtcaggagatcgagactatcctggctaacatggtgaaaccccgtctctaccaaaaatacaaaaaatttgccaggcatggtggcaggtgcctgtagtcccagctactcgggaggctgagtcaggagaatggcgt

SEQ ID NO: 8871 - DNA, 110 bp, Homo sapiens
gagacggagtttctccatgttggtcaggctggtctcaaactcccgacctcaggtgatccacccacctcatcctcccaaagtgctgggattctgattattattcttcaatt

SEQ ID NO: 8872 - DNA, 410 bp, Homo sapiens
tagcttctccaagtctctgttttctcatttacatatctgctacagtcatgaatgtatattgtctccctagaggattgtggggccatccgtgatgggataaaaattattaatgaggaaatgttctcaaacctaactagacggatagctggagagagaacttagatgtgtattttataaattaccatgtgcacatacaccctttttttggcaagtggtgggaggtatcagagattctgggtgggggctgtggcctaagcagctccttggtcattgggacggtctctgggccctgacgcatgggagggacagttggctggtaggacacttggaggtgggggctccagctaagccactgcagagatggggcgtgggccatgcaaggtggtgaagactgggtgtaggtatgtgtg

SEQ ID NO: 8873 - DNA, 309 bp, Homo sapiens
tacggctgccagaagacggcagaaggggcaaagggccccagttcctctggctggggtgtttgctgggcctaggcgcaagccacgcatccatatgggttcctctgcattgagaactgccgacaggacgtcctcggagtcccaagcaattgtctggtttgtgatggacccatctttcatttcttgattattcagtagcttcgtgtcctagaaaccaagaggaccatttctataaaagaggttggttgaataaagacagcgtgagaatagaggagctcctattcccgaagtcagctgcctgttctgctttca

SEQ ID NO: 8874 - DNA, 291 bp, Homo sapiens
gacagaagggtcaccctttcacatttctaccagcaatgcactagagttcaaatttcaccacatccttgccaacttgtgttattttgttgtttttgtgctgttgttgtttttaataacagccatcctaatgggtgtgccttccttaggaggcagccacatatgaaatccatgtgcctgtgttaatgcaaaggtggaatttcctatggctggcatgctcactgcacagggatggaaggccagttgggtggaaaggatgagaaagctgaggtcctggagggctttgagggacgg

SEQ ID NO: 8875 - DNA, 72 bp, Homo sapiens
gaaaatgactttagtagttattaacctgttgactgtacaggtaaccttcaggttccgattgtgtgggacagc

SEQ ID NO: 8876 - DNA, 458 bp, Homo sapiens
gctggagtgcagtggcacaatcttggctcactgcaacctctgcttcctgggctcgagcagtcctcccactgcagcctccccagtagctggaaccacaggcgtgcggctcattttttgtagttttgatagaaacaggtttcaccatgttgcccaggctggttttgaactcctgagctcaagggatccaccaactctgggatccaccaactctggcctcccaaagtgttgggattacaggcatcagccactgtgcccagccagtatacttaaagatcttttaaatgcagataacttactgtatgatttcattagcccaaatttctgtctctttaagcacaagtccacaatccctcatctgaaatattgaggccacatgtgtgttggaaatcaatttaaaatttttttttaaaagtgtgtgtgtgaagttatgtaaaccccattgctttgtggcagcacct

SEQ ID NO: 8877 - DNA, 633 bp, Homo sapiens
ttactcctgagaccattacaaattctcagcaggctgggagcacagttgagatggataggaggaaatcagtgcgtggctccttccttcctccttgcattcccacaacgttctcaagcatttgctggtgtcaggccctggacacagagagatacagaggagactccagagggctggagaccaagccctcctgcaggagctggtggtctaggaagggaggccaggcagggcagtgacattgtgatgtgaggggctctgagacaggggccctgaggaacagacagggctcaagagctcagggtcccggggtcctgggctagacctcttttccacacatgatgcctccttaccgagcaccctctgggtgtctcaaactcactaatggcacacagaggagggttaaattaagaaatttaaaaattggactaaatcactgccgctaagacagaattcctccatgccctggagtgggttcctccagcactcagttcccaaccagataggtcttggctcccacctggccctcttgtctgtctagccctgactttgtacttgccattcatttgatgtatcatgcatttatcaagggcccctctgggtgtgcacagcactgaactagatgaaatctgatcaact

SEQ ID NO: 8878 - DNA, 468 bp, Homo sapiens
gaattgtggaatggggaaacggggtttacagaggttaaataattgcctgtgatcacacagattgtgactggccaggtgatttgaactcagattgttcagattccagagcccagctccttacacaccaccacctgcctggaaaacaatgggaggcacaacaagcttttggagagtgatggggcatgatttaacctgtgccttaagaatgctgagcaggtcaggcatggtggcttattcctgtaatcccggcactttgggaggccgaggaaggcagattgcttgagctcaggagttcaagaccagcctgggcaacatggcaaaatcccatctctacaaaaaacacaaaaattagctgggtgtggtggtggcatgcctgtggtcccagctacttgggacgctgaagtgggaggatcacctgagcccacggaaggtcaaggctgcagtgagtcatgatcacaccactgcact

SEQ ID NO: 8879 - DNA, 354 bp, Homo sapiens
gttataaaaaatacttgaagttgcaaccagctattaattgaaaaccaaaaataggccagctgcggtggctcacggctgtaatcccagcactctgggaggccgaagcaggtggatcacttgaggtcaggagtttgagaccagcctggccaacatggcgaaaccctgtctctactaaaaatataaaaattagctgggcgttctggcatgtgcctgtaatcccagctgctcgggaggctgaggcaggagaattgcttgaatttgggaggcaaagattgcagtgagctgagatcacaccattgtacttcagtctgggtaaagagctgagatcgcaccattgcactccagcctgggtaa

SEQ ID NO: 8880 - DNA, 585 bp, Homo sapiens
  misc_feature 477: n = A,T,C or G
aacacattgtatcaaagatcatgaaagcaatgttttcattcaattaaacttgctagaagctaatgaaaactgcccagagaatttctctctgtaaattaaagatacacaacaaagattgtcacccgacatgttttcaactcaattaataattttggttagcaatagctgtaaggagtttgcatctgtgaagatcaaaccacagaggacatagagattaggcagaatttggctaagttgctaccaaagttttagtgtttaatccaataatcttcaaactcattaggtctgcaattgagttgcagatctctggagctcattctttattaagagatggctgaaacttcccttttccagttgggtggaagccctgagaggactccatattcttccccgggaggatgttagcacatctgccagtagcataagccagaaccaagaagtacatctgagtgtgaaagaatgtattattaaaaatanttagttttggactgatgatcttggacattttaatctgcctgtatgctaacttcaaccatctctcatttacaagaactatttaggaaaaatattgaatccacctggctg

SEQ ID NO: 8881 - DNA, 133 bp, Homo sapiens
ctagcacaatgtgttcatccatggtaacaggagagaaggcactgcacacagatgcagatgcagtcacataagtagatgttgtgataaaaatatatggacattttctgagaaaacagaagcaatcattagagat

SEQ ID NO: 8882 - DNA, 96 bp, Homo sapiens
gacaggtcttgattacatgaaggaccttactaaacacccttccatcctaacaaaaatatgtggagcatttgaccattgcacagggatgagttccca

SEQ ID NO: 8883 - DNA, 517 bp, Homo sapiens
gttgtctgataacagtaatatttttaatgtgttgagtgatatttttaatttgttaggcacatcgcaatcttttacatttatctgcatatatattatttggtcctcactgcatccttgtcaagttgttttggcaggcattattttctattttatctgtgggaacacagacccagcaggtctgtggtggaagagccagttagaaaccaagacctccacttccaacccagctatcctttcattctaacacactccctctggtaaattctagaaacaggcagcaaaacagccaaaaactaaagcagcttactttttcatatgtaatatgtaaatgaatagcaatggcaaatgacaatgggaatgtctattaagaaatatataataagcctggcgcagtggctcactcctgtaaataccagcactttgggaggccgaggcaggcggatcacttgaggtcaggagttcgagaccagcctggccaatatggtgaaaccccgtctctactaaaaatacaaaaatt

SEQ ID NO: 8884 - DNA, 491 bp, Homo sapiens
tgtgggtgggtttaagcatttggtaacacaaggaagaactcaaagattatgacatcggtggagagtggggggtgggggagtgtcagaggtatcgggagagtgcagaaggtttgaaatagttgattatagtaggaatagtgagctatagtactagattttcagagcacagtagtcatattttcgagcatcctttggtcccatgtggaattggagattctgaattatagagaaacccatctgccttatggtgactttctctggtagtatttcgttgccttaggccaggcatggtggctcatgcctgtaatcccagcactttgggaggccgaggcaggtggatcacttgatgtcaggagttcaagaccagcctggccaacatggtgaaacctccgtctctactaaaaatacaaaaatcagccaggtggtggtggtgcacgcctgtaatcacagctacttagcaggctgagtcaagagaattgcttgaacctggg

SEQ ID NO: 8885 - DNA, 433 bp, Homo sapiens
gcaggacccatacctcatagacagccaggtcggtgcaggcataggggatgatgccgagcatattgggcaggtagccgcggtaaagggcgcgggtgccctctcgctgcaagatctgcctggcgcagtccagcagccccttgtactggcccgtccgacgcaaggtcaaccgcgtcttcagcacctgaggatggcggggaacaaggcagctcatttgattgaatcctgtcaatgaccctcggggtagccattgtccccaccctacaaacaaggaaaatgaggctcaggaaggcaaagagctgggtttcagacccggatctgtcagattccatggaatgctctctgaattttgagttctgaagcacaaatgctggcaaaggccaagagagtgagggaagaaggctcacgtctgtcttcccagccctttgggaggctg

SEQ ID NO: 8886 - DNA, 94 bp, Homo sapiens
tgggcattatccttgcatttatcatctttgtgtctcagactcttgataatggcctacccaaactaggcatgacaataaatgttggttgaaatga

SEQ ID NO: 8887 - DNA, 477 bp, Homo sapiens
acaaggcacagccctagatcccttaaaccttgattccatacaacacatttttgtgagctcaaggttggggcaaagaggttggggcacagtgattggggcaaagttacagattaacagaatctcaggacaaagcaattgttcaaggtacaggtcaaaatggaatttattatgtcttccctttctacatagacacagtaacagtctgatccctcttccttttccctacaaaatagaaatgatcattagcaacagaagaaaactaaaatgagtaacttattttttttaaagtaacatactggctaggcatagtggctcttgtctgtaatcccagcattttggcaggtggaggggggcagatcacttgaggtcaggagttcgagatcagcctggtcaacatggtgaaacctcacctctattaaaaatacaaaaaatgggctgggcatggtggctcacgcctattattctagcactttggga

SEQ ID NO: 8888 - DNA, 600 bp, Homo sapiens
tgtcttcttccactactcagaaataaacatcatgttttgctctgtgtccttccagacgtttctgtcatataaacacactatgattagatttgaggttttgtaaaatggcatgacaatcataatccgtctgtaatcttctctattcatttaatgtgagcacctttcctcaccagcgcagataacaaatgccttacattctgtttttaacaactacttaagtttctgtagaatagagaaactaccatttttataactactgtcctctagatagatgtttagaatgcatacaactttttgctattattaacaatgctgcaactatggccgggcgcggtggctcatgcctgtaatcccagcactttgggaggctgaggcgggcagatcacgaggtcaggagatcgagaccatcctggctaacacggtgaaaccctgtctctactaaaaatacaaaaaattagcccgggcgtggtggcagataccctgtagtcccagctactcgggaggctgaggcaggagaatggcgtgaacccaggaggcggagcttgcagtgagcggagattgagccactgcactccagcttgggcaacagagcaagactct

SEQ ID NO: 8889 - DNA, 55 bp, Homo sapiens
ggtactcccatcacagggcttctgcttggcaacttatcttcctattatgaagctc

SEQ ID NO: 8890 - DNA, 450 bp, Homo sapiens
cggcctcccaaagtgctgggattacaggcgtgacccaccacacttggcccgaagacttattattatcccatcagcctttctctcatggaatttggcctcaaaaattaagtaaacatttaagtcaaaaggagagtgagaatattgccttctagcctttcatataagatttgctggtatttaatgaggcctgattctgcctggcactgtaccaatgcccttatttactggtgagaaaactgaagttcagagatgtaaagttatatggtctagctcacatagcttctgtgtggtgaagctggggttccaactcaggtctaattccattagagtcttgcgtctttcctgcctactcatatgtaccaagactcagctagtacaggagttgggcaaggtactgagactacaagggggaatgggtggtgagtctactttctgggtatagtcaaattc

SEQ ID NO: 8891 - DNA, 627 bp, Homo sapiens
ttgtccattcatttggccacactaccatagggatcctaattcttcttgagaattgattcttttgtttttgtttttgttgttgtttatttattttgagaaagggcctcattatgttgcacaggttggcctcgaaatcttgggcttgaggtatcctcctgcctcagtctcctgagtatctgggacaacaggtggatgccattgtgcccagcaaattattttgacttataattcattctggatgacattttatataataggactacagttaatgttggttttattttgcttatcttggttgttattgtgattgactttttaaaactttttgttcatgtttctttagcatttctaatgtttttcagcatggtaactaaatacttttatataatataaatgctaaggttacatggtaggcattgttcatgggcaccatgctatacacctataaattaaaatcagtacaatcatatccaaatgaatacaattatatcaggtgacagagttgttaatagctcagaagataaacggtttcaccattgctcagtagataaatttcttctttccaaaatgtgatttaaatatcaatacttccccagcactttgggaggccgaggcaggcggatcacg

SEQ ID NO: 8892 - DNA, 176 bp, Homo sapiens
tccgttgctgtcggtgcgccagttcacactccgggtcagagttcctggcccggtgcacctgagaggtcgctctccgactctcgctctggaccctcttgcgccattgaaccccctgatacgggggcctgagaccccagggcttaggagatggatccagtccctggcgctcctacttc

SEQ ID NO: 8893 - DNA, 509 bp, Homo sapiens
tgagaattggtgtaagacatcacaatcccattattcagagcgcgtatggagtggaaacgcttgtagggtttcaccaggtaagcggtgttgaactttctgcttgtgtattctctctgggcagagatgccacttgcctcccccaccatgccatctctgaagaatattacagaccattttggagcatggtgaataagaaattttcaccttaggagttcacttgaatagtcatttttatatttgtgactgcaagtcactcttaggggctgtacttccttagtactggtagcattattatccaatggacttttatagctttcattaggttttcttttgtttttgttctttaaagaacgttttacttatcttagtatttcatttttcatctatattatgaggcagtaagagtcttctgtttttccaaagttgagactgctttatatttatttcgtattgtctacagctgtagtgttcaatacattagccactagccacatgtggttatttaaata

SEQ ID NO: 8894 - DNA, 611 bp, Homo sapiens
actgaatgtagaagaccaacagaaatttaatggcacactaccactaccctttcctatatcattattcccctgggggtcatactgctattaaatcatctatttggtgtatgaattttggatcctaacattgatggagctgtctgaatctcctttgtatttacttgaatcagtgttgcctatctgttgtgcagccaatccaggatcagctccaggtaagccacttccaaaagctgcttggtataaatgatgatgatgaaaattatttattaaagtccagctttcttatcatctagaattttgttctgtagggaggtaaatctattttctcttgaagatacagagctaatttatttgactgaagcacttcatgacagcaatcatggaacacaaaaagaagctatcaatgtgcacacagaagcaagaacacaggccgtgcacacaggacaagcacagcaactgactcaaaagatgagcccttcccccagcagtcagtgggattcttctggtcttcctggaaaggataaagaacttatgagcactgtcactctaaaagggacagaatctaacgcaccttcatacaggccatctgaagcaaaaataatttggataaa

SEQ ID NO: 8895 - DNA, 413 bp, Homo sapiens
cctgggattttgccggatgtcattcaatggctttcaaggatgatgcacagctaggccataggagagtaagctcaaattcccaccctgtcacccatacacagaaactcattctggtttttctgccatgtctaggccatacaatgaaagtcgctgaagaagaatatgaattttgcctgcggatttgctaacactcgacaatcctaggaggtaaaaggcaaaagaggggctgggtgtggtggctcacgcctgtaatcccagcactttgggaggctgaggcaggtggatcacctgaggtcgggagttcgagaccagcctgaccaacacggaggaaccccgtctctactaaaaattagccgggtgtggtggcacatgcctgtaatcccagctactcgggaggctgaggcaggagaatc

SEQ ID NO: 8896 - DNA, 200 bp, Homo sapiens
acgacagaagggggctgcctctaggttctgggaagatggcgaaggtctcagagctttacgatgtcacttgggaagaaatgagggataaaatgagaaaatggagagaagaaaactcaagaaatagtgagcaaattgtggaagttggagaagaattaattaatgaatatgcttttaagctggggagatgatatttggtatat

SEQ ID NO: 8897 - DNA, 453 bp, Homo sapiens
cagtctctactaaaagacagaaacaatacactgccaaaatgttaagttgaccaccgtgaaacttctctattggagtgtctgtttctttaagctgtgaatactgaaattatgccttgtctcctccccaccccagggggatgccgttttgcagtgtggacacgtgtttgaagcagttactaaactcgtcatcctggttaagaaggagaacattgtcaatgttgttcaaggaaggtaggtggcttcatcttcagctcaggaagtaattcaatgttaaaatgtttattaaggccgagcgtggtggctcatgcctataatcccagcactttgggaggctgaggtgagcagataacttgaggctaggagttcaagaccagcctggccaaaatggtgaaaccccgtttctactaagaatacaaagattagccgggtttggtggtgcacacttgtaatccc

SEQ ID NO: 8898 - DNA, 432 bp, Homo sapiens
gttttctttgacatcactgcaccacaacacctgccttgcagttaaacagttgagcctggtgatagtaaaagagccaattctcaaaaaatgtcacagattttcttctaagcattctttatcacttggaattctcttttttgttgttgaatgatatttttatagtttgagaatacactttgcggggggaacattgactcttggattttgtatcactctgcactaaagtgtagctactacatcagagttctcagtaaaaacttctaatattcgaaacctgtccattttatcccctacccagagcagtcccagtgatcacgttgctcaaaatatttacttcttggttgaaaatatcaagaacaacctcaccaaatttccaaaggacatgaaactagctggggttgggaatattctaaatcatagaaatataattat

SEQ ID NO: 8899 - DNA, 300 bp, Homo sapiens
agtgagtggtcttaccaaaaatccagtatccttgccatccttgccaaatcccactaaaccaaacaggcgttccttctgtgcccagtcctagtattcaaaggaaccctactgccagtgctgcaccattgggaacaacacttgctgtgcaggctgttccaacagcacactctattgtacaagccacaaggacttctttacccacagagggcccatcaggactctatagtccatcaactaatcgaggtcctatacagatgaaaattccaatttctgcatttagtacttcgtctgctgcagaac

SEQ ID NO: 8900 - DNA, 137 bp, Homo sapiens
ggcacgagggaagagggaagaagagaagctggttatttctagaggatgtcgtaatctacatcacaggcagaactgatggctcagtggctgagtggccagtatattgtctttttttttttgaaacaaggtctcgtttt

SEQ ID NO: 8901 - DNA, 110 bp, Homo sapiens
ggcacgaggagggaggatcccctgggttgtgcatatggcgggaaggggtattccaggagtggaggatgtcagcagggtgggaatgggatcagtgaggggaggaggagcag

SEQ ID NO: 8902 - DNA, 688 bp, Homo sapiens
attcggcacgagaaatgctgaatattggtaacaagcaacaggggaaacaaggcagtctgagcacacagaactcaagtcctcctaatgggatcccagaatgcccatggaggaagcagcatgtgcactgtgctgagtgctgagcaggatttcaagagagcaaaggcagagatgctggacagggcagcacaggaggacgagtgtgcatggtcactctgagcagggctggttcctgggctggttggagcacagcatggggaactgaaaggcagacactggccaagaaagtccttgtgcagggcttcagaagtgagcctcacaagccatcctaggccacactgccatcaagccccagacctctacatgcccatttggtttctttccagctcatatagcttcctaagtattgtggctaacagttccctgacttgaattcctagtttctgttaacagttttctaactttcaggaaaaacaagccaatttctaaggaaagtggctgtgcttcagtcaggagtagtccgaggtagacatccaggacagtatgacgcaaagggtttggagcgcaacaaccccttgcgttatatagccatttaatgtaacctgtttgtgtgagttcatacctggctttgagccactattgtctgtgagtaatataactgcactgctgactctgtaggagagagaataaa

SEQ ID NO: 8903 - DNA, 539 bp, Homo sapiens
ggcacgagggtgggtggcagaggggaaatccaacatgcagactgtggcagtgtcttgaacttctgtttattcaggtcattgaataagaaactcttttcttctgcattcctgtctttctgcatgtgtgtgtgtgtgtgggctgggtagggactgtttttgagatcactgggctgaaatgtattctaggggtgaaggatctaggatgtacctgctcgtcatttcctgacttcaccttttaccaattcttttcttaacaaatttaaaattggtcagagcaggagctgctagctggctttttaacagtgtttctcataatggcagtactcagcaaatagtttttctcttgtctcctaaaattaagttgcaagactaatgtaacaaacagtaaaatttaagctaaagaactcagtatacgctgggtgtggtggtttacgtctataattccaacactttgagaggctgaggtggaaggattgcttgagcccaagagtttgagaccagcctgggcaacgtagggagaccctgtctctacaaaattt

SEQ ID NO: 8904 - DNA, 639 bp, Homo sapiens
cagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggtcagctgactttcacgatctcaggtactgatgaagattgtgaagattattacatcaagtgaatgtacgggtgatttagagaaagctggtagctaggctgttcaaggaagggcctctgtgagaaaggggatggctggctgggtgtggtggttcacgcctataatcccagcactctgggaggttgggagtttgagaccagcctgaccagcatggagaaaccccgtctctactaaaaatacaaaattagccccgcatggtggcacatgcctgtaat

SEQ ID NO: 8905 - DNA, 223 bp, Homo sapiens
ggcacgaggaactgtcccccgttatctctgtccatacagcaacagcccccaatggccctgaccacctccctccccagcagaacgccccttcgtgggtgtgaaaatactttctattctggtcagcaccaagaatgcctttttcccttctgcaggtcctccagtgattccccttaagaatgcccctttcaaagccacccccccatcgcagcggcacagctccctc

SEQ ID NO: 8906 - DNA, 183 bp, Homo sapiens
ggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttct

SEQ ID NO: 8907 - DNA, 343 bp, Homo sapiens
gagggcaggagagtgaccaagcagctagaagagagggtgcagcaccccaaggagaggactgggggagtgggtgttccaggaagggctctggcatgtaaagctgcacagaagtcaaatcagataaagcctgagagggatccatgggatttcttggcaaagggattgttggtgataccaggaagagcagcttcagtggctcatggggagagaagccagattacaggagatcagcaactgagagagtgagtggagagcatcttttaagaatgtcttgagtgcgggccggctgcggtggctcacgcctgtaatctcagcactttgggaggccgaggcgggcgaatca

SEQ ID NO: 8908 - DNA, 539 bp, Homo sapiens
ggcacgagagttttggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattggaaacttttattccagttaccaataacacattcctcatttcctccagagacctcaccagaaacacctttaatattcatatttctagcagccttctgttcataacaatatatgcatcctgttaagatgataggagatttctctgcacctctcctctttgtgagcctgcagggacattccctttaatgtccatatttctaccagcagtctcttcaaggcagtctaggtttttcctaacataca

SEQ ID NO: 8909 - DNA, 630 bp, Homo sapiens
ggcacgaggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaacta

SEQ ID NO: 8910 - DNA, 528 bp, Homo sapiens
ggcacgagcccatgtcccgcccgctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaagaaagatccagattacctgaagctgtggttggacacttttgtttctagctatgaacaatttttagacgttgactttgaaaagctgcctaccagggtagatgatatgcctccaggaatatctct

SEQ ID NO: 8911 - DNA, 331 bp, Homo sapiens
attcggcacgagggaagggaggtttaaggaagagactgtggacagaggtgttagggaaggtgtcagagaaggttaaggagccaacatggatcatgggggtggtacagtgttgccagggctggggaggattggctgcagtgtggggtacccagccgctgccatgtggagagggacctgtcactcctgctgtgaactctcccttcttctgccctctgacctcctgctggtgcctcccattggctaaacacagttgatggccagtgcactggggagctgttcttggagcccacaggcatctgcttcttggcacagagcagacaatggattgagt

SEQ ID NO: 8912 - DNA, 535 bp, Homo sapiens
ggcacgagcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttt

SEQ ID NO: 8913 - DNA, 603 bp, Homo sapiens
ggcacgagctaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccggatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgca

SEQ ID NO: 8914 - DNA, 422 bp, Homo sapiens
ggcacgagctttaggttcttgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcct

SEQ ID NO: 8915 - DNA, 573 bp, Homo sapiens
atccttgaaaaatgctatgttggaatcttaatccccaggacctcagaatgtgaccttacttattaaaaacagggtctttacagaggtgttgcagttacagtaaggtcattagggtgggccctaatccagcatgactgatgtccttaaaagggggactttggagagaaaaacatgctcaaggaagaggatgtgaaggctacgtgaagagactggagtgatgtgtctgcaagccaaagaacaccaaaaatcgtcagccaccacctgaagctggaagaggaaaggaaagatcttcccctagggccttcagagggaacacggccttgatctcagacttcccctctaagaactgtgggagaatcagcatcttttgtttaagcctcccatgttgtggtactttattgtggcagcctgagcaaacacagtggctaaggaaactaatttcaatcagagacaatattcaaaattcagcactggatattggcaggactaggcactaaccagtcagaagagatgacagctttgaactactcacacaggtgggccactgtggggcacagagatgatgtatggaaa

SEQ ID NO: 8916 - DNA, 410 bp, Homo sapiens
cagccaatcacaggcttccagctaacaagactatgcccaaataaggcaaatgcctcatcacatgatgctcaaatcaggcagccacctaggcgaggccaatcaggtaacttttctactttgcttaattgttcagcctgtacaaatttgctgcttatgactgctgagcagagctgtctaaacctcttctggtttggagtgctgccttatatatgaattggtctttggtcacataaaattggttaaatttaacttctctaaagttttgtattaaattgtatgtaaaacattggtagcacaatttggattcagatacccaaatattgactatgataatgtaaataatccttaagcagactgatttacaaaggcctgaacaagtttgatattctgaatattcacttcttctgatg

SEQ ID NO: 8917 - DNA, 411 bp, Homo sapiens
cgccggccgccctgcgtacgctcgcaaggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggc

SEQ ID NO: 8918 - DNA, 164 bp, Homo sapiens
acatagctcgccttttgcaacaaaacgacttacaggaacagaaaaagagaaagaaacactttccagaattccctgcaacccgtgcttatgcagatagttactattatgaagatggacaccaaccagggtcaaagagggccaaggaattgggttctggattctca

SEQ ID NO: 8919 - DNA, 501 bp, Homo sapiens
ggcacgaggtttatcgaggacacaatgaggatgccaaggcacagagaagttaaggaacttgtccaaaatcaccttagtgataactggcagagcttgaatcagaattcaagtaatctggcgtcatgtccaataccactaaccattgcattctgctgcctctcaaaaataaaccaggcatagagtaaaattcatctgtagttcaagaaacaatttattgaagcttcctttttctgtcaagtttggaaaacgggagagaagataggaatcgagactgagaagacgaccaagtggttctgagctgagagaactgggaaattgaaggacgtagattagctaagggaagatacaagtacctgaatccttctaaaaattttttttattgaggtgaaattcacataacataaacagccattttaaagtgaacaattcagtgacataatattcacaatgttgcacaaccaccacctctatctagttccaaaacattcccggccgggcgcg

SEQ ID NO: 8920 - DNA, 62 bp, Homo sapiens
tgaggagtggagctgaatttgaatgcaagccttggcaccttaattgagcaagtttgaaacct

SEQ ID NO: 8921 - DNA, 383 bp, Homo sapiens
  misc_feature 383: n = A,T,C or G
ggcacgagcaagaactgggacgtcgagtggtctggagattacagcctctgccccaggtgcacccagctatatgagaaaggtggggaccgggcaggggaactggatgctgggggccacaggggaatggccaggctcttttacaggctttagcacagaccctcttttctcatggctttccaccttgtagctatgggactatctcttcaactcagggaactcttccacaggagtccatccagtatgtaaaacagggacacatagctcctctgagggtggtgggagtggaaggcctgggaccccactgtcttggtgtctgaggtacttcctggaacctcacgtctccattgagcggtttggaagccttattcaggcagtacattagn

SEQ ID NO: 8922 - DNA, 325 bp, Homo sapiens
  misc_feature 219: n = A,T,C or G
agcattaacatagaaactagagattagtagtactggagccaagttttatccaaaatcgtgtggctctgttattttaaatcaaaagacaaataagaaaacaggacactttgtgtccctagctttgaatctgattattttgtatattccaaaaaacacctagacccctggatttttccacagcagctctacttaactatcagtgaaaaacgctgggacatnccaccaccaccaacagcaccccttatgagattatccaattgtttaaaagcccagctttctttctttgaaagtactcacttggggagctatcctgcctaacaggtat

SEQ ID NO: 8923 - DNA, 423 bp, Homo sapiens
gaaaagtaatgggagatgaagctggaggtctaagttgacataagatataaagatgaagggcttatacttcagattgaaaataggattttatataaaccaataaaaaggaacaatccacaaggtttttaattagggtagtgacataaccaggtttatgtttggtaacaactcagcaaaagacagaatatggcccagagtacagaaaagtcagaggcagattaattagctaaggagattacttactaccattctctagtcaaggaatgaactaaactagcagcaatgtgcataacacaaagatagaactgagcggacttaggaattaggaaggaaaacaattctataggatttggtgataggctgactatggaggtaaagaaggggtggaagaagactatgatatttctaacttggggaattggg

SEQ ID NO: 8924 - DNA, 573 bp, Homo sapiens
catttttcattcatgtgtaaagttatttagtaagactgttgttaatcttccagagtgatagaattttagaagagaccctggacatctagacattttttatgctactacatatggaattatactttactggtgactcatcccaaatagtgtatttttcagagttaaaagatttgttacggctgggcgcggtggctcacacctgtaatcccagcactttgggaggccgaggtgggcagatcatgaggtcaggagttcaagaccaggctggccaacatggtgaaaccctgtctctacaaaaaatacaaaaattagccaggcttggtggcacaaacctgcaatcccagctattcaggaggctgaggcaggagaatcactcgaaatggggaggtggaggttgcagtgagctgggatcgtgccattgcactccagcctgggcgacagagcgagactccatctcaaaaaacaaacaaacaaaattttgtcacaataaagtgattaaacgccctcttcaaaaacaatagaattgtcagcctgccggcagtggctcatgcctgtactcccagcactttggga

SEQ ID NO: 8925 - DNA, 215 bp, Homo sapiens
gggttctgtatatctcactgtaaccttgacctcatgaccttgagctcaagaccctgggttcaagggatcctccccactcaccctcccgaataactggaacatcaagtgcttgctaccacacttagctaatgtttaaattttttgtagatacaggatctcactctgttgcccaaactgatcttgaactcctgggctcaagcgatcctcctgccttg

SEQ ID NO: 8926 - DNA, 527 bp, Homo sapiens
tcttatcttcatctcatcattcaacctccacagttgcttcagcagagaatgagggagcccagagggttgtacacaagctctaaatgcttcagcctgtacttacacagagctcatagccccatgcagaattggccacgtcgttctaccaaactgttagggggctggaaagtgtgtgaaataacatggctttttgatgaacagaaatgcatttccacaagctgttacaaaagaagggtagtgatacaggtaggtaaaacgtgtcccctacagactgggaccctaaacaatgtttaaaatgttgatatataaaatgtagtcaatcggaggagccaagatggccgaataggaacagctccggtctacagctcccagcgtgagcgacgcagaagacaggtgatttctgcatttccatctgaggtaccgggttcatctcactagggagtgccagacagtgggcgcaggtcagtgggtgcacgcaccgtgcacgagccctgcttgggcgaggcattgcctcactcgggaagcgc

SEQ ID NO: 8927 - DNA, 534 bp, Homo sapiens
gagtgcggtcacatacttccagaagagcggaccagggctgctgccagcacctgccactcagagcgcctctgtcgctgggacccttcaggtaggacagctcccaacgctgtggggactctcagcaaaacttctccttcctttccacggctctgcttcttctgacctcatcttagttttgctttttcttttcttccttcgctatttttctacgatcctctaagaaccaagtccttgaaacttttggctcaaagtggatacagagacaactttttctagaaagttcagaaaagtgtattttgaggacggagtctggggaaatcaatgggatggggctaaaatcgtgcctggcagtgaccgggttcttgttctaggatgtggagggagcagggactttgaaacaaactgggataggatcctgtttatggaggaaacaccacacaccttggaaatgacatcgggaactggccagatgtttttcacctcctccgttttgattccgattgcttcaggacttgaactgttactccgctcgct

SEQ ID NO: 8928 - DNA, 585 bp, Homo sapiens
ggacttaaactttataatttttggttatcatgaataatgctgttataaacatttatgtatgagcccatggatatatgttttaatttcttttggatggattttagggggagatcaagaagttgctgaagtttttttttattgttgtttattttatcttttttaaagaaatggaggtctcactgtcttacccaggctggcttcaaactcctgggctcaagagatcctcccacctcagcttctcaggtagctaggattacagccacacaccactgtgcccagctaggaagttgcagaggttttgattactcctggcctttagttttctgaagataggatgttaattcaatttgctaaaatgaagtcaggatggcagtaggggttttgaggcaaggaataatggtttggtttaatatcctatagggaatgggaaggagagctgaccaagggcagattaaaggaattttaggtgccgtggaagtttgtgctgaaattgaggactgttgaatctataagattttcctaaaagtgctcagctgcctggtagaagaagcagagaagagtttagtcagaatgagggagtgagga

SEQ ID NO: 8929 - DNA, 413 bp, Homo sapiens
gaacttaaagtaaaaaatgaaatcaaataaatcaaataatgttttgggttttttttgttattttattatttgtataacaaagaaacccacacccatttgcagccaacttgcatttccctccaaccccctaatcctaagcaaccacgaatctttttgtttctatggatttgccattctgcatgattcataacaacagaagcatataatgtgagctcttttgtgactgccttctttcacttagcataatgcttccaaggcttatccttgttatagtatatattaatactcagtcctttttattgccaaataatattccatcatgtggttaattcatttcattggttgcacaattctgtgaatatactaaaaacattaagttccatacaccaactaggtgcattatatcttactga

SEQ ID NO: 8930 - DNA, 468 bp, Homo sapiens
cgttcccccgctacatagtctttcttttgtgttatttagtttaccatttcttttttccatcttgttataacctccacgagttgtgtctcttttgttttctacattatacccaacggctagcacataacaggcacccaatatatactgaacgaactaaggaatgaatgaaggaatgaatgaataggtggcttataggaaacccctggggccagggactctgcaacatcaccatgtaactttttctttgtgctgagaagcagagagaaacaatagaagatatctcttaatctctcaaggatgctactcccaggactgcttgcaatttccgaggagataagccacaagttacagaaaggaagcagctgtgtagggcctgcaagtttcctgctgcaagtcaccctatgttcagaagttaccctggctgggccaggcatggtggctcacgcctgtaatcccagcactctgggg

SEQ ID NO: 8931 - DNA, 457 bp, Homo sapiens
tggctcacacctgtaatcccagcactttgggaggccaacgtgggcagatcacttgaggtcaggatttcgagactagcctggccaacatggtgaaaccctgtccctactaaaaacacaaaaattagccaggcgtggtggtgcacatctgtaatcccagctacttgggaggctgaggcatgagaattgcttgaacccaggagacagaggttgcagtgagccatgatcccaccaccacactccagcctgggtgacagagtgagactctgtctcaaaagagttattaccaaaacaatagactataaaatctgtagtcttaatttgcatatcatggtagacaggaaaatacctttagcatcttaataaaagatgaatcaaactctctaataaataccctagaaaagacaaacaatacactaaatataagattaaagagtagtttctaatacatcattctaag

SEQ ID NO: 8932 - DNA, 194 bp, Homo sapiens
tcctccaacgcccttttgatccaagattgattaagagacattggcagatgctgagaaggacaacccaattgttataacttgcagaccgatggggagatgggttccagtctgcacatgactcatgcacagtccccccaccccaccctgacttataaaattccaaaccgactacaagaccagaaacaaaccacatg

SEQ ID NO: 8933 - DNA, 333 bp, Homo sapiens
actactacttttcatgcaatacttcacatacaacttgagggttacagaatccagattaagcctctgttctggaaggattatcacagaaacccacatttacttatttcagagggggtcatctgcttcccctctgccctttctctaataaaacttcaaaaaaacagaatattgtcaggccggacgcggtggctcatgcctgtaatcccagcactttgggaggccgaggcaggcacatcacctgaggtcattactgacttctagaccagcctggccaatatggagaaaccctgactctactaaaaatacaaaaattagctgggcgcggtggcatgg

SEQ ID NO: 8934 - DNA, 500 bp, Homo sapiens
ttagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcacaagatggtaaggttcgaatctttcgggtgatgggagttaagtgtgaacaggaactgggatttaagggccacact

SEQ ID NO: 8935 - DNA, 72 bp, Homo sapiens
gctgtgacagcctcttacctaagtaccttaagagattttgtgtgaaaagcaagcctttcccacaggacacga

SEQ ID NO: 8936 - DNA, 403 bp, Homo sapiens
tacaatataaacaacattgatgatatatgtatattatctacatataacccagaaaatagaaaaagaaaatttcagtacacaggaacaatattgttcacaaagtagttttcaataaactttaaagaaattatattatacaaaacacgttctttgataacaattataaattatgaataaaaatatagtaaaatatatattagaaactaaaactcctaaataatccttgaatcaaagaggaaatagaaatggaaattacaaaatttttagaatgaaatttttatgtactatataaaaaatgtgtgtaataaagccaatgtacattcatagacataagtgcatgtattaaaacaaaacaatatgaaaaagaatttcaaaatatccagtgtattcaattcaaaaaact

SEQ ID NO: 8937 - DNA, 567 bp, Homo sapiens
ccgttgctgtcgaataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtt

SEQ ID NO: 8938 - DNA, 415 bp, Homo sapiens
cagcacacaaacagtggcttatccaggtccatcatattattacaaaattactattatcactattatgtaataactgtttgcttaaaactattttgctttcaatgtatttgaaacactttgcttatctaacacattaaagctataaagtcatataactttcctctccatttcacaagacagaagataagctcagaagactggacctatgttgaatggtttggctaggatgacagaatcagtatgaggaagatcttggacctaagtcttctctttatgtcactcttttatcactctgcattgtcagttgtacatacacattaaattgagtggtgacaatttgttaggagataaagtaggtcttcagttttcaatcttgccccctctgcagcccccttcagccctgtggacatgggcc

SEQ ID NO: 8939 - DNA, 315 bp, Homo sapiens
gggcattatcacaccagaatttcactgctgtccagagtttacctctgcatgaatgtctctaggctgattgctctctgctgagtactaacgaaggaaatccaacattcatgttctactttgggctttctgatgacacaggagcctggcttgtattcagtacacatatattgatgttatgtgacttgactaggccataaaaacgataaataccttttaatagcacctactatggaccaagtgctgttataagcaatttacacaaatttaattgtcaacctgggggcggtggctcatgcttctaatcccaaaattttg

SEQ ID NO: 8940 - DNA, 344 bp, Homo sapiens
gcctctcactcataggaggggcccaggaaagagggaggaggcaagaaggggaaggagcacaaggagtgtgggtgaggggtgtaaccatgagggcaggcagggggcaggacggaaggcaggagggcctggccaggggaggcctcaggaggatgagcaggaggcgagaggagacagactatgaggccagagggagaccctcacctgagaatctcctttagcgtgcggtgcaggaatgcataattgtcatcgaatttgtaccaaggcatgaatggctgaccttcactgtacacaaagttttcccagcagtatgcaaattctgagacgaagaggcaggaagcagtcag

SEQ ID NO: 8941 - DNA, 526 bp, Homo sapiens
cttgtacagtatttctactttttattctaatcaactggactgttgcattatttttatgtagattgctaacaaggtttttgaagaaacactcttaaaagtcataaaagggaaaatcttgacagttctgggatattgccacccttgaccttttggaaaaatgtagacagcatctcccaggcatgacgcctagggatcgtgtttatctgtcatcagttggtgactccatgtttattgagcactggctataagccagacttggtgagggactgaaacaattacaagacacagttctgcactggaagaaataggaatcaacctaagatttcctgtcctgctaggtcatcaggttcctgtcccactactttccttcctctaccaaattcacttatagcctccaagtagtgtaactatcaatagcacccctttcactccccaaagtgtcctaatttggagagtaagttgtatgatcaccctacctacagtctgcctgttttccaatgcacactttgtctctcccctgctcttg

SEQ ID NO: 8942 - DNA, 308 bp, Homo sapiens
ctaattacggttaatcacagtagaaaataaaacttgattccctttcctgcatggcttgagcatgaaataggagaagggacaagacaacctccgggtattgtttctaattctttaaaaagttgtacttgcagccaggcacggtggctcactcctgtaatcctaccactttgggaggctgaggcaggcggattgcctgagctcaggagttcgagaccagcctgcgcaacatggtgaaacgccgtctctactaaaaacacaaaaaattagccaggaatggcagtgtgcacctgtagtcccagctactcggg

SEQ ID NO: 8943 - DNA, 87 bp, Homo sapiens
agcctggttccgatgaacgcaactctgaatgcctggaacattcaaatgctcttgtttgaggaggtggccaaatgtaaatggattctg

SEQ ID NO: 8944 - DNA, 117 bp, Homo sapiens
actccccgccctaagatctctgtgtgtgtcctgggggaccagcagcactgtgacgaggctaaggacgtggatatcccccacatggacatcgaggcgctgaaaaaactcatcaagaat

SEQ ID NO: 8945 - DNA, 300 bp, Homo sapiens
aattccgttgctgtcggatcagccagtttagaggacctgtgggaaaatctgagtttaaagcctgccaactcccctcatgtaaatatctctacaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcag

SEQ ID NO: 8946 - DNA, 391 bp, Homo sapiens
gcagtggcatgatcttggttcactgcaacctccacctccctagttcaagtgctcctcagcctccagagtagctgggactacaagcaaatgccaccatgcccagctaatttttgtattttttatagagacagggttttgccatgctacccaggctggtctcagattcctgggctcaagtgaactgtccacctcagcctcccaaagtagactattcttatattttcctttcattgtggagtaaaacaaaaattgtttcatatgaatacattttcacagtaggaagaaacaaatttcattcttaactgaaacttacaatggccagaaattaagccactcccaaagtcattaattgtttcacctttggcttcttacctcccatttattgaaaatc

SEQ ID NO: 8947 - DNA, 346 bp, Homo sapiens
atttttctcttccccaccacagcatctttgcgtgtgtgtgtcggcgggtgttggagggggcaagttaagcctcattccctataatttggaacattccttcggatttgatcgagtcagatagagttggtcaaacccaatgggaaaaagactaaaggaactacaaaacagaaacaaacaaatgacaacaacaacaaaaaaacaggtaagcaaaacaaacaatcaattgcacaacttatacaattagtgagcactctaatggtaaggagaaattaagtccagctggttgttaatcttaactttggccaagacaaaccccagttcagttacttacctgcagacgggtctc

SEQ ID NO: 8948 - DNA, 272 bp, Homo sapiens
  misc_feature 129, 133, 136, 137, 140, 147, 149, 155, 156, 157, 158, 159,160, 161, 180, 182, 185, 186, 190, 194, 197, 199, 201, 208,209, 214, 218, 220, 221, 225, 226, 228, 237, 241, 245, 246,248, 251, 253, 255, 256, 261, 267, 270, 271: n = A,T,C or G
aattccgttgctgtcgacaaagtcgcagatgcatacaagactttttcaagaaacacatacagtacaaattcttagatgaagactttgtgttcgatatatacagagacagtagggggaagggggggaagnttcntgnnacntctttgntnatcctnnnnnnncatgatttactactttaangnggnnttgntggntantngnaccatgnncattncttnanngtcnngnttttcttantaantcgnntnttncntnnactgncctaanatnnt

SEQ ID NO: 8949 - DNA, 409 bp, Homo sapiens
tacgggaacatctggtcaggattcagacttcccagttactgctgcttctacagtggactttctcaaaataaaaaaatcatgtgaagaaaacgtatgcagatctttaaaagactgtgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatg

SEQ ID NO: 8950 - DNA, 295 bp, Homo sapiens
agaacagttaatggagacgtactctactactttgttgttgaccactggctatttggggaacagtgtcaggtggatttggcatggctattaaaataatcaacttaaataaaaaaatacatcccaatataattcccttgtagttcttttagttggatttgaaactgttccacaactgaaatttggaaaatcaagttatattgaaggtggagggaggaatggttggctgaatttaaatgacagatttaattgttttgttttgttggagaatactgtctataaatgtctaagaatttgg

SEQ ID NO: 8951 - DNA, 440 bp, Homo sapiens
actcgtctgagaagaagagctatcacctgagcgctctggagaacttagccggagctttcaggcagtctgggagcctacatggaggcgtgtaggcttatgtctcatgtccacgttgcccgggagacaaaatccttttctatttagagctgccccaaaatgttctgcaccagcttctcactgcggtggcttcaccttagcatacaggtatgtggacggccactgtgctggctcaccttggacactgccttcatgggcctgggtcaggttctcagtcagcagctcttgccaactccaggaggcccagacccaggagtggcctcctgctgccggacacgaagagggaaagagctgagctgcccggccctcttcttctaacaagccctcctgggttgacaaagaaagtctctccctgcactgggtgacactggacactgtccctg

SEQ ID NO: 8952 - DNA, 528 bp, Homo sapiens
caagtgagaaagctgtggttgaaacagattcagtaacttacgcaagtttatattctctgtcaagtgacccagctgggatttaaacaggccttttgactctaattctagtattcctcccatgtgcagtattttattttatattgcacaatagataaaatataattttggtttctccttttttattctaaaagagtaaaagcagttatctcaatatgttatgttcattctagtgatgactttactatcatgtactaaatgtgttttgtttaaagtagaagttaacttcacgttatactgatttgtccccccataaaccaactgtatgtcatcatataacaaaagttgttaaaagtgctatataccatataatgttgcatctaaactgggacacttatctgagatgcttttgcgtgggacaaatgctatattagaaatgactaggactggccaggtgcagtggctcacacgggtaatcccagcactttgggagactgaggcacgtggatcatttgaggtcaggaattcaag

SEQ ID NO: 8953 - DNA, 433 bp, Homo sapiens
ttggcaggaacacattgaagactaagagtttttaggccaaatcatcgaaaataaataacatcacttgagaaatgatcagagaaataagaaagggccaccataacatgaataagacctactgtgaaggagaaggctttgccatttctatgctatttagggtgaactttgagttatggtgttctgttgggcacatcacatattgaaagaaaagtttgaaaagctaaagtcattgggagagcacacaggatggcaaaaagtcataaaatctttcttaacagcagtggttgaaatagttggagccacttagtttaatgaagacaaattagtgaagacagtgtggctgaccccaaatatttgacaggctttcataagtaaaagggatattggcctcatatagctctgaagtatgaatggctgtaaatggaaattggac

SEQ ID NO: 8954 - DNA, 519 bp, Homo sapiens
atttactatgggccacgttcttgctgtgctccttctccctgtggttttcaaaaaccagtcacctaacctgaagcctcaaactcttcatctgcaaaaatgagttgtggcaggtgcctctgaagcaaaaatcctgggctagaaggagtgtcgtcatctaaggcaaaaaagaaaaacaaaatcaagactaagagaggaggaattagaatgagactcatgtaccctccttccccactccaggggaaggagagactgtttgggaatgccctcccactacttccagggcagaggctgtgcagaggagccttggagaatctgcagcccactgatgactctgcttcagtcagtgtttctgactttctgatggagaggcctcccattgataagatttttgtcactgcagctaaatgggggcttcaaatacaaataagtttcagttacagaaaaaaaaattcttgcacgtttaagcttatcccttctacggtattatctgtgagaattatagaccaaccataaggcact

SEQ ID NO: 8955 - DNA, 356 bp, Homo sapiens
cctcagcctgctgagtagctgggattacaggtgcccaccaccacgcccagctaatttttgcatttgtagtagagatggggcttcaccatcctggcccggctggtctcaaactcctgacctaaggcgatctgcccgcctcagcctccctgagagctgggattaaaggcgtgagccaccacacctgggcaccttatttttttatacggctctactgcatacagttgaataagaaaactattcctgtattgctgcactttcacactgcttcaaaatcggcctaggagaaacaatgctttaattgcttcgggtgcatttaattcctagagccaacgggcttggccaaaggcaacctaccc

SEQ ID NO: 8956 - DNA, 440 bp, Homo sapiens
  misc_feature 32: n = A,T,C or G
aagctcctgtccccaaacaagaagcagagganaaaccacactagcaagctgcaagagttggcactgctgctgcccatagccctgaagacggggaccaagaagctcacaaaggtacagggactagaggagaggggccagatttgggacgcaggtctttaaatagcagcaaatgggtcaccctctcctgggaaacctggacagatcctttcagtggcagcattcaaatgggaatggtgctactctgaacgggaatttccgggagtctgtgatcccataactaggtgcctggaggatcctttttttgcaaaggagagaggagaaaccgggctggggaaatagagatagcacaaagatcattgttccaggaatcaaatagccatgggtttgagccctctagcttcacagctacagaactctgggcagtttctcaggctacccag

SEQ ID NO: 8957 - DNA, 510 bp, Homo sapiens
acccatccacccatctactcatccatccatccaaccatccatccatccatccacccatccacccattcatccatccatccacccaaccaaccatccaccttttcatctatccacccacttgtccacccacccattcctccattcatcattcaaccctctcttcctaccatcactgtttcatccatgaagatttataaagaagtgtaacatttggagtttataaaccagtatttgagacctaattctaattctttccgcctgtgcaatcttggacaaatagttaaaattatctacattttttgtttattctttggtaaaatgggagagagtgcttatctttacattatgaaactactatgagaagtagatgattcagctggttgggtgtggtggctcatgcctgtaatcccagcaatttgggaggccaaggcgggctgatcacctgaggccaggagttcaagaccagcctggcaaacatagtgaaacaccgtctctactaaaaaaaaatac

SEQ ID NO: 8958 - DNA, 560 bp, Homo sapiens
ttccttccttctctctagcatcatattctcagaaattcttcctgtgttgctccattccagttcttataagtgattgttgcatgtggttttgtctagttttatctgtttttggtggaagagttattttaatacaagctgcactggaactgacttttgaattgaaacctctttccatgcttggttcaaaccaatccctatacgtaatggttatgagcccagagttggagccagggtcctgaattcccacctctgacactttctggctcttaatctctgactatttgcttaacatctctgtgcctccatttctatataagtttttttacggttattatttatttaataaatggagaaacaaagacccaacatgacacctggcaatttggtggcagaacctaaatctcaggtgtcctaacttccagtccaaagcatagagaaaaatagcagcatggagataatagctgtaagaatgttaattctctagagcatgcatcaatattattaatataaagtaaggccgagtacagtggctcacacctataatcccagcactttgggag

SEQ ID NO: 8959 - DNA, 479 bp, Homo sapiens
agagaatcggcctgaagctccctggagctccctggagggttccaccccccttgctccagctcacccagagttctacgattcaaaacagctggaaatgtgtgccctgctctccccaacaagaaaacagaacagaacatggctgtttctgccaagcgaattctgaataagctgcattccatttcattaaaacaattacctgagctccagccaagaattacataaagcttcctcccagcatcaccccctcccccataaaacacacatcatgctgctttcaaataggcagagtgaagctctgagccctcgctagaagacctcatagtcctcgccaagtggccagcctcggcatctctgcacgctgacatagatgacatgaggctgaaagaagaccttggcatgaagccctcccctcatgagagcctgctggctgcccgaaatgtttctagtaggcaccagggccctcacctctgcctcagagc

SEQ ID NO: 8960 - DNA, 636 bp, Homo sapiens
ttgcaaaggctaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagtgtcattgtaggggtacctcctgattcccagaacctctcaataaaccctatgctgctactgactggacgcacgtggaaaggagctatttttggaggctttaagagtaaagaatctgtccccaaacttgtggctgactttatggctaagaagttttcactggatgcattaataacaaatattttaccttttgaaaaaataaatgaaggatttgacctgcttcgctctggaaagagtatccgtaccgtcctgacgttttgaaacaatacagatgccttcccttgtagcagttttcagcctcctctaccctacatgatctggagcaacagctaggaaatatcattaattctgctcttcagagatgttaaaaataaattacacgtgggagctttccaaagaaatggaaattgatgggaaattatttgtcaagcaaatgtttaaaatccaaatgagaact

SEQ ID NO: 8961 - DNA, 300 bp, Homo sapiens
ggaagaaaagtggcagcatgaacagtaagagaatcattacaggctgggtgcagtggctcgcgcctgtaatcccagcactttggtaggctgaggccaggagtttgagaccagcctgggcaacatggtgaaaccctgtccttacaaaaaagttaaaaattagccgggatgtgataccttgtgcctgtggtcccagctacgtgggaagctgcggtggaaggattgcttgagcctgggagatcgaagcttcagtgaaccgtaattgcaccactcccttccaggctggaggacagagcaagaccc

SEQ ID NO: 8962 - DNA, 407 bp, Homo sapiens
gctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgctcctcatttcaatctcctgtacaattgctcctgaacagtagtacagaattgtagagatagcacattatgcaacctggctttttatctgagacatacttaatgaaagcac

SEQ ID NO: 8963 - DNA, 432 bp, Homo sapiens
ggcacgaggtattaaataagatgtctttaaacagaaacacacatatatgtattgattgattaatgaggctctcaagaacctgactctgtgtttcccctacgagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacattataatatgtgctatatattaataaatttttttaaatgtattaatatctgctcttactgagagagttttcagcctgctgaatagtcagttttacagtactagctaaaccttcttttcttttttttt

SEQ ID NO: 8964 - DNA, 400 bp, Homo sapiens
ggcacgagccaagctgaattccagattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctcaccctcacctttatgccttatat

SEQ ID NO: 8965 - DNA, 582 bp, Homo sapiens
agattgtgccactgcactccagcctgggtgacagaacgagactccatctcaaaaacaaaacaaaacaaaacaaaaagatgcatttattggccctgtttgcatgttttctggaatccagaacataaacccctaaaaggaccatctccagtcctttgcttcaaagaatcagcaggttagccttgttcatcaaggggcaatcctcctgagttctgtccccaaagagaaaaagcaatgcctaccacatataccttatatttaaccatgagaattgagctggatttctagagaacagcaatggattttgagccaagtgttcactcgagttccagcacagggacacacagtcccgatgggagcatccaaaatggaatctactatgttcaagaatatacactgtctcacacacaaacatcctgcaggatagaccacagggtatgctgtataagctcctcaataaatacagaaatacacaagtatgggtggggcgtggtggctcacaccaataaacccagcacttaaagagggcaaggcaggaggatcacttgagctcaggagttcgagctcaaccagcatgggtaatat

SEQ ID NO: 8966 - DNA, 560 bp, Homo sapiens
  misc_feature 403, 418: n = A,T,C or G
ctcccgagtagctgggactacaggtgcacgacaccacgcccagctaattttttgtacttttagtacagacagggtttcaccatgttggccaggctggtctcaaactccggacctcaggtgatccacctgcctcagcctcccaaagtgctggggttacaggtgtgagtcaccgcgcccagccaataaaaacatttctaattttacattaatattatgaaatacaatggcagcttatattgtttttacacacacaaaatttctgaagccagtcactgagggagaagtatataaactgcaggtacagccatcctattcatcacatggtagagtaacaacagatgctaaagatgacattatgtctccacttaggaattccatggaaaagggaaaaaacggtaagcanataactattacgcanaattgtatttaatactaacgatctcttgaagagttcagatgagaggctaaactagctgtgtaatctaagctaaatcttgagagatgactgagattttcatgtttcaaaaaaggggacagacctgggagcagtaccaacactc

SEQ ID NO: 8967 - DNA, 72 bp, Homo sapiens
gggagtttctcctgatcacctttgtttaatttcagattgaatattttataaacaaactgaaacttatgcctg

SEQ ID NO: 8968 - DNA, 567 bp, Homo sapiens
attgagacagagtcttgctctgtcgcccaggctggactaaagtggcacaagctcagctcactgcaacctctgcttctcaggttcaagtgattctcctgccttagcctccaaagtagctgggattacaggtgcccgccaccacacctggctaatttttatatttttagtagagatggggtttcaccatgttggccaggctggtctcgaactcctgacctcaggtgatccgcctgcctgagccttccaaaatgctgggactacaggcgtgagccgctgagcccagcccaaccctagaatttaatagtgaggggaaactgaggccgcagatatggaagagacaagcttgtcccagaacgtttctcatccttctcatgcagagccttttctcccaggtcatgttctttattgaagcatcacttctacaggctgcaagacacagaagatcagggaccaattgataggagcaggagcaaaggaagtaatattattttgtggcttccaaaaccacaaggaatgagagttgcaaaatgtgttcattcaatccattcaacaattatttattgagta

SEQ ID NO: 8969 - DNA, 647 bp, Homo sapiens
ctgggactacaagcacgtgccaccacacccagctaattttgtttgtatttcttgtaaagatggggtttcactgtgtcgcccaggctggtctcaaactcctgagctcaagtgatctgcccacctcgacctcccaaagtgctgggattacaggcatgagccaccaagcctggcctgctataaataatttaattttcattttaaattaataatttgaataacttaattctaaattaaacttgtccaaaactgactctttctgccaaaaacctgcactctattttgattccctgtccctctgactgaccaccttgtcatggttcaggcctgaaatatgcaaatcagactctattctccttttctgttatcaagaaggagtcattccaagagggagtgacatacattataatagacacattatatttctttaaatttttatggattcaaataaatataaacacttttttcacatggaatgtatccctttttgcctataaacatggtggaggtggcagaagccatgggagtgctaaggggaagcctggtgcatcacctgccactgtcattgccatggattgccctccatttaccaataaagtcctgttgggcctgtgttttacgcaagctggtctctgtcacagagtatggct

SEQ ID NO: 8970 - DNA, 616 bp, Homo sapiens
gcttcatttcatttaaacttccccaaaaccttgtatgagtggagtctggggattcagaagaagacggtggtcatcacagaagttgaaattctctactgtttacttcttcaaaggtcttgttagcggtggccttgaaggtgatgaagaaagacactttcaaggtggacaggtataattattgggtcaccaagaacaaatttgaaaaacaaaatatgccaattgaaattagcatgtagcacctaaatacccagaagcttcttcattgaataatttattcattgaataaattatgtaaactgaattagtaattcctagtgaaatagtggatgaattgagaatagtggtattggtaaaaatggaaaaaaatttttttcttctgagacagaatctcactctgtccctgaggctggagtgcagtggcacgatctgagctcactgcaacctctgcctcccaggttcaagtgagtcttgtgcctcgcttgaggcacaagattagatttagtagagatggggttttgctttgatggccaggctggtctcaaattcctggcctcaagtcatctgcccacctcgacttcccaaagtgctgggattacaggcatgagcgaccgtgcct

SEQ ID NO: 8971 - DNA, 365 bp, Homo sapiens
ggctaattagcaatggggatttatggttatttctagcccactccgaacaatgagttatgtaagcaaagcaacatatataaaaatgtaaataggccggtggctcatgcctgtaatctcagaactttgggaggccgaggcaggtggatcacaaggtcaggagttgagaccagcctggccaacatggtgaaaccccatctctactaaaaatacaaaaaattagctgggcttggtggcaggcgcctgtaatcccagctactcaggaggctgaggcaggagaatcacttgtacccaggaggtggaggttgcggtgaactgagattgtgccactcccctccagcctgggcgacagagtgagacttctttcc

SEQ ID NO: 8972 - DNA, 575 bp, Homo sapiens
aatccagctaatatgtattaaatatgcactatgtgacaggttctgtgagggtgttggggggaagaaagacagggtttctgccgtaacgagccaataatctccttagtaagaaaaaaacttggaatgagaaaccattcattcgtttagccatttactcaactgataatgtatcctgggcctattgtggactgaattgtgtctttccccattccctgcccaaattcatatgttaaagctctaaccccaatgtgactatacttggagatagagccttttgggaggtaattaaggttaaaaaggtcataagagtggggttctttggtaatcccagcactttgggaggccgaggtgggtggatcacgaggtcaggagatcgagaccatcctggctaacacagtgaatccccgtctctactaaaaatacaaaaagttagatgggcgtggtggcgggcacctgtagtcccacctacttgggaggctgaggcaggagaatggtgtgaacctgggagtcggagcttgcagtgagtcgagatcacgccaacgcactccagcctgggcaacagagcgagactccgt

SEQ ID NO: 8973 - DNA, 546 bp, Homo sapiens
aaatacatgtgaaaatcaagatctaaatacacatttgaactttagaagaacttaacttacatattgtaagatgaaaggtttagtttctaattaaagcaaatttggttttgtaagagtagtatgtaaaacactgccctggccctgtgcggtgactcacgcctgtaattgcaacactttaggaggccaaggtgggcagatcccttggggtcaggagttcgagacaagcctggccaacatggtgaaattctttccgtattaaaaatacaggccaggcgcggtggctcacgcctgtaatcccagcactttgggaggccaaggcgggcggatcacctgaggtccagagttcgacaccagcctgaccaacatggagaaacccgtctctactaaaaatacaaaattagccgggcatggtggtgcatgcctgtaatcccagctactccggaggctgaggcaggagaatggcttgaacctgggaggcggaggttgctgtgagccgagatcgcgccattgcactccagtctgggcaacaagagtgaaactccgtct

SEQ ID NO: 8974 - DNA, 276 bp, Homo sapiens
tccctgtctctttttctttttgcttttagttggctgggcacggtggttcatgcctataatcccagcactttgggagggcgaggtgggcggatcacctgaggtaaggagttcgagactagcctgggcggatcacctgaggtaaggagttcgagactagcctggccaacatggtaaaaccccatctctactaaaaatacaaaaactagccaggtgtggtggcaggctcctgtaatcccagctacttgggaggctgaggcaggagaattgcttgaaccc

SEQ ID NO: 8975 - DNA, 437 bp, Homo sapiens
atctcggctcaccgcaatctccacctcccgggttcaagcaattctcctgtcccagcctcctgagtagctgggattacaggcatgcgccaccatgcccagctaattttgtatttttagtagagatggggtttctacatgttggccaggctggtctcgaactcctgaccccaggtgatccgcctggctcggcctcccaaagtgctgggattacaggtgtgagctactgcacccggtctataataacatttttaaaatttataaattattgaaatgttttatatcaatttaaaacattattattcacagtttaccacttcatagtgctgtgttaaagaccatactaccattattttcaaagaataagatctcacatccccaggagtacctgaggagtgctgagacagcatgaaataaacatgggatatttctaaattgct

SEQ ID NO: 8976 - DNA, 578 bp, Homo sapiens
  misc_feature 196, 343: n = A,T,C or G
gacagaagtaaaagtattaataaacttaaattttaacaatgatttgatcaattagttataatatcctacctttccactctctcctttgtaaagtatcggcatgcttatgctattacagtactcatttgctataaattaactttaaattaaatgattttgcattgttacacaattgattgatacttgtatttcaggncttgggaattactgtttgatatttttgtatgcaacatagatataaatcatactacacttagtcaaagtctggactctgaaggaactttaaaaatcttttgattaaatttctctctgttaatggtatgctcctactcatcaaaaattntcataaactccagtcattacagatgtcaacatgtgcaagaaacagtacagtcaaattataacagcaaatttatatcaactcttttgtttgctttttttgagatggcactctgtctctcccaggttggagtgcagtggcatgatcttggctcactgctgcctcccgtattcaagtgattctcctgtctcagcctccccagtagctgggactataggtgtgcaccaccatacccagc

SEQ ID NO: 8977 - DNA, 409 bp, Homo sapiens
gtctctattagcttaacaaattacacacacgcacacacacgcacatgcactcatgcacacacacacacacatgcactcatgcacacacacacacacacacacacacactgctgtataagcaagttcactatgaacccatcagctgggacccaccatttgattctcctgacaacagctgcaaagaagagcaagatatatgaggaacaggacagggcaaaaaacaacatacatcagaaacatactgccatggagcaaatgaaaattgtgaccaaatatttgaccacaacctaagaaattaatgaaataatcacctctttaaaacaagagcacaaagccaaataaaatattcaaggaagacacaacactagaagatgtttcaacataatatgaaaaaacatcaaaacttagg

SEQ ID NO: 8978 - DNA, 341 bp, Homo sapiens
tccaaagaaggaagaacccatcttccacgccatgatgtttgttgtttgcttttaaatataacatacatatagaaaaatgtacaaataaagcatacagcatgatgcccttttgcaagttggatatttttcggaatgagcctctaaaccaggaaacagtcctttagcagcacctgggaggctccctcattctctcttccaggcactaccaccctcaagggtggcctgcttcctgagttttcataccatagaatagctgggcccattttatatacaggtgctccttgactcacaaatggattatgtcccagtaaacccattgcaagttgaaaatatggtaagtc

SEQ ID NO: 8979 - DNA, 510 bp, Homo sapiens
tgaggggacacccacaaacggagtgaccaccagccccacacctcctctccccggggcctggaatctcccaccttgatcctctggggttctaattctggctcaggggcagcggaaagattcctctgcttttcctcctttttaccatctacttatgtctgaatcttacctctgatctttccattgcctctgtgggaaaatggtagaataattcttacatgccaggctcatgtccagtcaggccaatatggacaatgtttagtgtgagtgtgcatgcgcgtatgcagttaagagcaagtgccttggccgggcacagtggctcatgcccgtaatttctgcactttgggagactgaggtgggtggatcacttgacgtcaggagttcgagaccagcctggccaacatggtgaaaccccatctctactaaaaatacaaaaaattagccgggcgtggtggcaggtgcctgtaatcccagctactcaggaggctgaggcaggagaattgcttgaaccca

SEQ ID NO: 8980 - DNA, 439 bp, Homo sapiens
tgcttgaccacactttcactggcaaagatttaaagacaatcagtattacagctatatgattaaaataatttaagcaataaattaaataaaatttggggaattaaaatacaacctaactttttatccagatctagcaagtggtatttttatttttattgcaacctttcagaattcatattaggatattttaaagtctaagtgttgtatgaagagtagtatattaattataatggtgttaacttcatttaaacttacctgtatgttgattattcttcctctgtaaaattaagccacacagataaaacgttctgctatacttaacaagatagatatttgtataaaatgaaagttaagatattatccatagtgtaaatatttatcattcattacaactaaggggagactgtacccagatgatttcttcttggaaacaatattt

SEQ ID NO: 8981 - DNA, 423 bp, Homo sapiens
ctctgggggcagctttcaacttgcaattgaaaaggcatgggggaggaacataggaaattcttaacaaagagaccgtcgccatgggaagcccttactcattcttacatctcagaaagccaggaaagtagaaggctcaacctgttgataggagtgctaatagaagattcaaaatgtgctctcccttctctcctgctcgtatcagtcatcatctcatcccactgcaacttcttgcagagatggcactgttctttaagattggtgcagtgtctctaacacagcagaggcagtgaatttacaaaaccctggtcctactgcctttgagccctccaactggaaattagttaaacaactttagctggccgggcgcggtggctcacgcctgtaatcccagcactttgggaggccaaggcgggcggatcatga

SEQ ID NO: 8982 - DNA, 441 bp, Homo sapiens
gcttacactgggcaccacacatgccgcgctgagcagtgagaatcaaagcacttctagttttagaaagtgtcctggcactagtagtaacccaggtttccaaagggatgcagaataggcatgatagtaggccagaatacacacacagtgccagactcctgcttcctatttctcaaaaactgtgcttccggctgggcatggtagctcacgcctgtaatcctagcactttgggaggccaagacaggcggatcccctgaggtcaggagctcgagaccagcctggccaacatggtgaaaccccatctctactaaaagtacaagaaattagccggggcatggtggcgcatgcctgtaatcccagctacttgggaggctgaggcaagagaattgcttgaacccaggaggcggaggttgcagtgagccaagattgcgccattgcctgggc

SEQ ID NO: 8983 - DNA, 491 bp, Homo sapiens
gagaagtgcaaaggccctgaggtgggtgtgttcttagcacatctgaggaatgtactggagagaaccacttaaagggaacatggtatgcgctcagagggccaggcagaaccagattatgagtggcatcgtagacagtggtcagcaattcaatattatttggacagagatgggaagtcactggagggcttggtgcagaagagtggctcactctgacttaggttgtgaaggtactactccaactgctctgtaaagaatgacctgtatgttggtcaaggacagaagcagggagacccactggaaaactgtgacgatagtccaggtgagaaatgacggtggctcagaccaaggtggagggggaggaggtggcaagcagtcatcagattccaggtatatcctgaaggtagaaccaaaaggatgattcctggattcctggatttctcaccaaatgaaagaatggagttgtcatttatggaggcagtgtaagctgggca

SEQ ID NO: 8984 - DNA, 58 bp, Homo sapiens
gttggggcaaaaaaatataatggggggagacattatatataaaggtgatatttacttc

SEQ ID NO: 8985 - DNA, 95 bp, Homo sapiens
cgcaccaagagttcatggccagaaattcagtttgttgaaagcaagattaacaagaacactaatctaagcagcacagagggcctggggagtgtcac

SEQ ID NO: 8986 - DNA, 64 bp, Homo sapiens
gtatctttccttgaaaatgtacttaaatataccctctgactattaaaaaggtattcaaataatg

SEQ ID NO: 8987 - DNA, 589 bp, Homo sapiens
atcacaggtcaagcaatgcatggcagtgggctagattcagacaggggagcctcaatttaggacccccagatttatcatacaaggtggaggaagggttcagatagggacttggggattgccaactctgaccctctcttcagatgaagagattagccctgtggaggagtccaggatttgtattttagtcttggtactgggtgttctgggttgagttgctagaccattctgggacaagttgctagaccattctgggacttactttcttcctccataaagtcaaagggtaggtagatcacacatttttaaagtgtgctccttgaggtgtgtcaggggttccataagcatttgctttcagttttattaaaagcagcctgtactctcaaatttgagtatatttgaaattgtaatgagagcagttgctcaggatggagtgtggtggctcatgcctgccccacactttggaaacctgaggtggaggaaaccttcaggccaggagtttgagaccagccagggaagtatagggagaccccatttctacaaaaaacaaaaatattagctgggtatagtgggacacatgtgtagtttgaac

SEQ ID NO: 8988 - DNA, 635 bp, Homo sapiens
  misc_feature 530: n = A,T,C or G
gtaacatttattccataggaaaggaaagtcataatttatcatgtaaggagaaataagtttgaggacaaaactatacacacacacaacacagagacacacaaacacacacagagacacacatacataacactcacgagatacattattctgttaagaaatgtacctacacacagcatgagtttcaagtcactcacctataattatgtttctctgaccacattacaataaaatcaaacactgaaaatatttggccctgaatttgattacacagctatcaatattttcataaacaatatgaaacctaagtgcagggcatatggtggtatcaagaaaatattttaaaagctcttcttcaataaagttaaaggtcatgtaaaaactctataaactttttctctataaaattgaattgggttaggatcaagaaaaataaaaggcttcagccacttgaatatttgtactaatgtcactcatttacattccttctcatcagagagcggcctgaagacaacttaatctagatgactcanaatacacaaaactcacttgcttcacttgaatccaaaattagaggttagaagttcaaatgttactacagcattgtgcataatggtaaaatactgaaaatagtctga

SEQ ID NO: 8989 - DNA, 371 bp, Homo sapiens
aagaaaaaagtccatggtacaaggcaagtgcatgttgtgttggccatgtcggtattcagcttgtaaatatctatcattgtcagagcttgcatttaaggaataaattcctagtcacagccatagtcatattttggggatgtcaaaactggcctcagaatacagaataagtaccatttcccattgttgaaagtacactttgcttctttattacatttgtttctttatcttctctatagtctatgttaactgtatttcttcttttcaggctggctaaagttcaagaaaatactattgcttctttaagaaatgctgctagtcatgtaagtaacctttaaacaactttagactgctgaggtagagaaatatggatc

SEQ ID NO: 8990 - DNA, 496 bp, Homo sapiens
ctttttgttttgagaccgagcctggctctgtcgcccaggctggagtgaagtggcaagattacggctcactcagcctcaacctcctgggctcaagtgatccccttgcctcggcttcccaattagctgagaccgcaggcatgcgccaccattccccgctgatctttatttattttgtagagatggtggtctccttatgttagccaggctgctctcaaacacttgggttcgaactcctgggctcaagcgatccttccacctcggcctcccaaggtgctgggattacagacgtgacccaccacacccgtaacaatctttcacctttttgacaaaatcttttttataaaagccgggttttatcaaaaagatgaaagatggtaacaagcgttgacaaggccatggagaacagacagcttttgtacattgttggtgaaaatgtaaagtagtacaaccattatggaaaatagtatatagatatttcaaaaactaaaaataaaat

SEQ ID NO: 8991 - DNA, 260 bp, Homo sapiens
gaaaatctaagacctgagtaactattaaatattacttactcatgcatcaatcctctgaccactgtatgtcccctgacatgagaatggtagaaaagggtgtattagtaaggcagcaataggccgggctcagtggctcatgcctgtgatccaagcactttaggaggctaaggcaggcggatcacaaggtcatgagtttgagatcagcctgatcaacgtggtgaaaccctgtctctactaaaaatacaaaaattaaccgggca

SEQ ID NO: 8992 - DNA, 511 bp, Homo sapiens
gattcacaagcactttatattattgatcatcagtttccacatttattcctttgaaagaaatacatccttggatttttctgtacatattttgacatttgttactgacaaactatttttatcatcattaaaaataataataacaatgatatattttttacctgaaagcctccatttcttttaggtatttttcttcattttggagcttcaggtcgacattttaaatgtgaaatggatttattttttccttcggttcatcctctaattttactcctgcctgtttatgtcttaaaacttgatagagttaggccgggcacagtggctcatgcctgtaatcccagcactttgggaggccgagacgggcagatcacctgaggtcgggagttcaagaccagtctgaccaacatggagaaaccccatccctactaaatatacaaaattagccaggcgtggtggcacatgcctgtaattccagctactcaggagactgaggcaagagaatcacttgaacccg

SEQ ID NO: 8993 - DNA, 318 bp, Homo sapiens
cttccacatgcatggacactgccagggctcccacatgaccttccaatggtggtgcaaagcacccagggtctgcatccagcagcttcagtcaaggcccctgctctattgctctggcgagtctcaatgacttgattcaagaggcagcatgggcccgggcttaaaagagccgggccggttcctcgctgtgtgaccctaagcaaacaatatcacttctctgcttcctcatctttttttaatttaaattttattttcttttaattgagacagagtctcactttgttgtccaggctggagtgcagtagcgtgatctcggctcac

SEQ ID NO: 8994 - DNA, 412 bp, Homo sapiens
agtgaggactataaatatcactgaattactatggaggtgggctgctgctatgggctgtgtggaaatacttttgatgatgtgtttgcatgtatatttcttgggaggaactcctgtttaatatcccatgatgaaatgctgagaatctgccaggcgctgtggctcacacctttaatccctgcactttgagaggccgaggtgggcggatcacctgaggtctggagttcgagatgttagaaacaaatgctcgttcctcagtgcggaaaagaagaactagcactcagacaaagaattttctcagcaaggcaattttactttctgcagaaagggtgcttcttggaagtctgattgccatgagagcaccttgaacaaagaaaagcagaggtttttatccctgctgcattgggtccttact

SEQ ID NO: 8995 - DNA, 297 bp, Homo sapiens
ctcctgtcctcctgtaggatccaggctaagctggagaggcctcactggtgtggagctcgatgacgtcatctaatctattagtttgtttggggcccatgagggcataatccactgatggcctcatcgccatgccgtgggtccacactaccctcaagctgaggctatgcttcctatagcaggaataccaaggctctttcccaggagtcctgatgagaactttgtctcaaggactcctcattggcctggccggaactttcttagtgctgcctttagtctaagactttttctgtcccacct

SEQ ID NO: 8996 - DNA, 444 bp, Homo sapiens
agcgcaaatcaccacctggagtacaggtgtgcccctcgacctcctgcggtttgttggcatgaagtctgtagaggtgccaagagagctgcagatgcacagtcacctgctgaagacacatgttcaggtgggcagcctccaaatggctggttattgcttctgcttcctgctcagcaaaggagctgacgttggtctggtgttttcagttgtctgattcatttgacaaatatttattgtgtgtcgttaggttctagaaactgatcctagtgttgttttggtactgatagtcagttacctcagattttcccttcttttctttttcctccatgtatttatttatttatgcatgttcatacattacatgtacctggaatacatgcacactataaaaaatacagagatacaagaatgtctgtttttatttttccaaccagtgagtagaaaaca

SEQ ID NO: 8997 - DNA, 522 bp, Homo sapiens
gttaaagtgttaagtgaaataagaccttgaatggtgaggaatggtcaaacaactgctgtaagaattacgagggatagaataccaagccaagagtcatgcaaatcagggatactaaagaatgaggaagcagagttggttttatgtaagcaaaagcaaatagcaggaagtgtagcctttttaaagaaatctcagtaccacagcctgttgggagagattatttgtgattgggagaaatgggagccatcagcaagcggaggggcttggaagtgatggatttttttcatggtttttttcttctgactccgttcgagattataggtccctagaaggtaaaaatctggtctttcattccacaaagtgttttttgttttgtttttttgagacggagtctcgctcttctcccaggttggactgcagtggcgcgatctcggctcactgcaagctccgcctcccgggttcacgccattgtcctgcctcagcctcccgagtagctgggactgcaggcgcccgccaccacgcccg

SEQ ID NO: 8998 - DNA, 404 bp, Homo sapiens
ttcaccccacccaaaacacagggaataagcatagcaaaaacatctaggggcagctaggagcagggacaagaggagaggcttagtggcagctggcacacaaatctcaacaagctgcagatcctactggctgggttgaagactctgcctggatctccaaacgcgagtctcatggggtgtctcaactgtgaacatccaacaagctgacatatatcctcagcactctgcatgcaccacttgatgtggctggcatcctgagcacaccatagacatcaacatgtatgtgctccctccatggagagcacacatgaaccaccacagattgcatgtgagctttcacacataggacacataaattagcagacagctctgatggatcaggagaaagtgcacagccaagaaccttc

SEQ ID NO: 8999 - DNA, 395 bp, Homo sapiens
gctgtcggaagtaccgtgagtctgatggaacctcatctgtttgaattactagcccagagggtcatcactctttacctgcaaacagtaccttctctgatgtctgggagaggtggtttatttcccatatacttgttaagtgtagatcttggggaagaacaactaacaccagaaacatcacatgttggctgttggggaggtgcttgtccattttgtatcccttttattttttcccaatcaacagagatccagttagaaggagcagcaagaccttccaggaggccatgctggaaggacatggggtgaggaggatacctaaccttcccttgcctcagtttctcatctgtaaaaaggagggtgatagtatcatggatctcaccagaatactggagagctga

SEQ ID NO: 9000 - DNA, 503 bp, Homo sapiens
atcacctcaagccagccagttgattagaaatattgacaggtattcagagaataaatttaatttgaattccttacacaagcaagttttcagaaggttcatttgttaatcgatttatctggaaatgagaaagccccttttccatagaagtgtaggtccacacaggctcgtctaatataatctcaaataatagatcattttaatgagaaaggtagtaagcaatgcagtgacatcactagtaatgatgcagttttataatcatacctccgtgaaactcaatataaaacctgtccaaatgtagaatgcaatgaaaagtcaataggcggccaggcacggtggctcacgcctgtaatcccagcactttgggaggccaaggagggcagatcacctgaggtcaggagttcaagaccagcctggccaacatggtgaaaccccgtctctactaaaaatacaaaaattagctgggcatggtggcaggcacctgtaatcccagctactcaggaagc

SEQ ID NO: 9001 - DNA, 349 bp, Homo sapiens
atcgcatacgggtacacgaactatggtgtctgacctagaaaaggcacagatctctctactggaaagaaaacgatgtaaccgattgcacaagggtgcccagggaagacccacgattgcccatcaaaggaacatgggtgaggatgcacgaagatgaaggaatgcacctggcatttctctcactgtgctcttaccgcatcagcaacccccaacttttgggcctactctgccccccatgcgtgaataccctgcttggatgctgtgcttttgcgcgttgtctctaagcccctttctccagggcatgttggtttccctggcctctcagagacctaactggagcctagagtgcctt

SEQ ID NO: 9002 - DNA, 543 bp, Homo sapiens
ggcacgagatgcctagtggtctctgagtgtaggattcttgaacctgctgatttgcatttcacctgtagttctacagtaaaaaatgattttatataacttttggtatataagtctcaaaaagtgtgagtcagaagagatgaaacattatatttaaaatttcatatcaaagcttctaatacaacgttgctagagccatggcttggaaataaatcaggaaaaaaccctcaaatacagaatcagttgtgttaatgcactagaacttgccttctgctttaaagccataattaatcatttaaatgctggataaaaaccatgtgttttgtctttagaaaaggtgttgagtggacttcaaggtttagatctgtgctgtcccatacagcagccactagtcactagcgggcctggctattgagcacgtaatatgtggctattgagatgtgctctaattatcaaatacacaccaggattcaaagacctagtacaaaaaaagaatataaaatatctcacaaatattattgtattgattacattttaaatgataat

SEQ ID NO: 9003 - DNA, 469 bp, Homo sapiens
ggcacgaggtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaact

SEQ ID NO: 9004 - DNA, 550 bp, Homo sapiens
ggcacgagattcaaagtacatttgacaacccactgcaagttgtggcatacatgggtgccatgaaccatgacaccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactccct

SEQ ID NO: 9005 - DNA, 280 bp, Homo sapiens
  misc_feature 65: n = A,T,C or G
ggcacgagcagagatctgcaaattacagcccacatgccagctgcttgtttttgtaaataatgttntaccggaatccagccactcccacttgtttacatatcatccctggctgcttttatgctacaatgaagtggagggttgagtagttgaaacaaagaccttattgcttgcaaagtctgaaataaacacactcacacacactgatttatgtatagaatatgtatacaaatatatcttttatttatctatttttttgagattgagtctcgcttgttgctct

SEQ ID NO: 9006 - DNA, 510 bp, Homo sapiens
ggcacgagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttctt

SEQ ID NO: 9007 - DNA, 236 bp, Homo sapiens
ggcacgagaatcagtcagatatgcctagatgaagaaacaaaatggcaatctgagtagaagaaataaggagaaaggaggagaggtgtgaaaaaaagtcctttttctgagaacaagcattcaaacagataaaacacaggtttcataaagaaaagttaaatgtcccactactatgagtcaaaatggtgcatttgctttttcctgggttttgatttattgccctctgtttgtaccccaca

SEQ ID NO: 9008 - DNA, 577 bp, Homo sapiens
gcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttc

SEQ ID NO: 9009 - DNA, 480 bp, Homo sapiens
ttgaggatctcgaccttgtccttccagcaggtgctcccaagccacctctgggcctgagaataggcatcacatgactctgtttaatcctccgacacagcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgc

SEQ ID NO: 9010 - DNA, 127 bp, Homo sapiens
ctcacctctctccccaagaaaaacatgtgaaatgcgagactgtgcgctcttaatgacatctatattaagggatctgaattctccatcataaatgaacatggtagcttaccaaatatcttctgataat

SEQ ID NO: 9011 - DNA, 550 bp, Homo sapiens
ggcacgagagggggcgggcccgtacgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataagg

SEQ ID NO: 9012 - DNA, 516 bp, Homo sapiens
ggcacgagcccaggctggtcttgaactcctcagcttttactttagcttcccagtgtgttgggattacaggcatgagccacaatacctggccaagtccttttttttaatcaaatgacttattaatacacagtttctttgccagcttttgttttcatttgctatcaaaaatgttgcttagtagtgctttgatctgagttatcaataacaggtaaatgccattatggataataattcaaaaagaagcttattaattattaggcctatctgagagtgaagtaaagttagcattttctttttgtttattctacttattgtttatttgtttagagacagggtctcgctgtgttgcccaagttggagtgcagtggtgctgtcataactcattgcagtctcaggctggagtgatcctcccatctgaccctcctgagtaggtgggattagcatatgccaccatgcctggctaattcttttattttttaatttttttgtggagatggggtcttgccgtgttcaggt

SEQ ID NO: 9013 - DNA, 403 bp, Homo sapiens
ggcacgagactgtggagagatctcagtttttctatctgtaattgctcatattttgaatgctaagttttcatcaaccataatttttacgtgctctaatatgtttcttcacagattcatgccatgttcagtttaaaagagtcctgttcttttaatacattatctttgaaatgcctcttactgaggaatgactaaacttcttctgaaatgtgctctctggattgaagtcaagagtacatgttgcaacaaagataatcatgacttttagtattaagagacaattaccagattgagtgctacttagaaaagtttccctccctgtgcagagattactgtacttatcaaacaacccgccccatgtgggcaatatataattgagataattagtatccaactgatactaaaa

SEQ ID NO: 9014 - DNA, 295 bp, Homo sapiens
  misc_feature 216, 224, 231, 239, 251, 262, 265, 267, 275, 281, 283, 285: n = A,T,C or G
ccagcctggccaacatggcaaaacactgtgtacactacaaatagaaaaattggccgggcatcatggtgtgtgcccgtagtcccacctactcaggaggctgaggcaggagaatcgcttgagcctggagggcggaggttgcagtgagacgataccgtaccactgcactccagcctgggcaacagcaagactccgtctccaaaaaaaaaaatttaaaangatttttnttatggnggtttcanaaatggttgtgnggcaggctggntgnantggcacangcctgnantnccagcacttt

SEQ ID NO: 9015 - DNA, 473 bp, Homo sapiens
ggcacgagcatttcttgtctttattaatttgacttctctagggacctcatttaaatgaaatcatacagaatttgaacttttgtatctggataaaaaatatatacagcattttgctgactgtaaaatgtatttttttgggccgggtacggtggctcatgcctgtaatcccagcactttggtaggctgaggcaggtggatcacctgaggtcgggagtttgagaccagcctgaccaacatggagaaaccccgtctctactaaaaataaaaaattagccaggcgtggtggcacatgcctgtaatcccagatactcaggaggctgaggcaggagaatcgcttgaacctgggaggcggaggttgcggtgagccgagatcgcgccattgcactccaagccttcaattcctatctgtgagtaggtcctcaaggcttcctctgctcccagtcggacaacccatcggctgggacagtactgat

SEQ ID NO: 9016 - DNA, 429 bp, Homo sapiens
  misc_feature 349: n = A,T,C or G
ggcacgagtagggtcttagtactggtttgggcataattatactcagtgtttgggcctctgctaaaattctaagacgataagaatatcagtttaagttctgttacagttgttttcatgaagcttgtaagattgatatttaagtggacaaagtgggaagtagtcagttttcagggctccaggggtcatcactttgtgctcagagtacagctgtcaactagtgatttggtgcatttagacaaggaacaggagcaaagggcctatttcaagagggtcatagacactgccttgtgataagtgaatggctagagggtttcttggtaaactgaagtccttttcacatttttagctntttctgtggcaacctgtcttttacagaagctactcatgaactctggcttttcattttcagggttgggctggacattcttt

SEQ ID NO: 9017 - DNA, 276 bp, Homo sapiens
ggcacgaggcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggc

SEQ ID NO: 9018 - DNA, 271 bp, Homo sapiens
ggcacgagcagactcgcattatggacaagtcccttctccccacacaaaggatgacatacaccgcatagtccatttcatttcagctcctgatggcatctgaccgccgtggacacttcccagtggtctggcttttggagggagagtagagcgggggatgatctgtgccagttggtcactccttggatattggagttatctccactggtcttgctgctcctctgtgttgattttcattaactcatttcacctcagtgaattctggagcctggct

SEQ ID NO: 9019 - DNA, 434 bp, Homo sapiens
  misc_feature 422, 426, 427: n = A,T,C or G
cattcggcacgagattgaacaccagtatacaataactttagggtcatatggatcattggtttcacgattacagtaggtctggtgcatggcactcccagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaactgaggctagagcctcattcctctgactcctaatncagnngtctctc

SEQ ID NO: 9020 - DNA, 99 bp, Homo sapiens
taattgtttttcttatttaaaaaaaattttttttcttttttctttattctttcttttttattctaaattctcggatccatgggcaaaatgtgcaggttt

SEQ ID NO: 9021 - DNA, 397 bp, Homo sapiens
ggcacgaggagagagagagagagagagagagagagagagagagagagagagagagagagagagagagagagagagagagagagagagagagagagagagagagagagagagagagagagagagagagagagagagagagagtgcgcgcgcgctctctcactctctcgtgtgcacacactctctctatatatatgtacacacactatttttttttgttctctctctccctctatatgtgtgtttttttatacacacacatatatatccctctgtgttttctctctctctctctcaaagacactctttttttttttttttcgccgcgcgattttttttctctagagagaacacacactctcacgtgtttgtgtagagagtgtctctcttatatacactc

SEQ ID NO: 9022 - DNA, 347 bp, Homo sapiens
ggaggagctcaagcagctcttaccacatgatacaagagccggctggtggaagagtggggaccagaaagagaatttgctgaagaggagaaggaaaaaaaaaaccccaaaaaaaaaaattaaaaaatcccccccccccaaaaaaccttgcccttaagggggaagaaaaaccaggccttttaaaaaaggcaataacaacactttttgttgccagaatccctttgttttggttgaaaggatttttgtggccaatttcttgaattataggggggagttccccccccccaggatccaaggggcaaagcggggcccccgattgtccgtcttgtccgcgtgccgccttcccaagg

SEQ ID NO: 9023 - DNA, 425 bp, Homo sapiens
gtctgttggtcagatacagtattttgatgatttcaatcaataactctgcaagccttggtgttattactggtgtctttttctgtctgctttcccccacccccgtccccacattttatttgctttctcaaaagcatctgcacacagatacacgggtggacatcctcagaggcagggtgactcagccgaacagaaccctgcaacatgcactggcaaaagtgccccacccagcgtcgaacacccgaccttgtcatttacccacgggtgctagcacaatcagtgtgctatgattgaggggcggctcttccccctgccaactaaaccctggggaaaatgaacactcaaactccgttgttggtatacactgccattagccaaaggaacaaatgatcaaatggaaaaaacagacattttgttgtttgacattt

SEQ ID NO: 9024 - DNA, 298 bp, Homo sapiens
ataggtctgagccacagtgcccaggccaaactttatcttataaacatatttgcatgtctgtgaattaatgatgtactgcagcatcactaaattagaaagagacaggaaacaatttaagcattcatcaataaaggactgattaatatatggaggtacatctacacaacgaaatactatgcatctgtaaaatagaaccaggaaacatatttttgtttgcatatggataatctttttctggaaagatatgtaagaaactgggaacaaggggctgggtgcggtggcttacgcctgtaatccc

SEQ ID NO: 9025 - DNA, 397 bp, Homo sapiens
gaattcggcacgaggagagagagagagagagagagagagagagagagagagagagagagagagagagagagagagagagagagagagagagagagagagagagagagagagagagagagagagagagagagagagagagagagagagagagagagagagagagagcgcgtgtctctctctctctctctctctctcacacacacaaaggggggggggagacaccccgatatattttttttctctctctgctcagtgcgcccccccccctctctctctctgtgtatatatatatatctctgttctctctctctctctctcacccctcttttttttgcgcccccctctctctcgagagatctctctctctttttttcacacccccccacgcgctcttttt

SEQ ID NO: 9026 - DNA, 342 bp, Homo sapiens
  misc_feature 323, 342: n = A,T,C or G
gacacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctatggcatcacatctccgggaatctttgctagcagtcaaccgggtcaaggaaatatataaatgataaatccaagtgtgggaacagcagtaatgaactttaaagaagaagcanaggcactaggggtgatccn

SEQ ID NO: 9027 - DNA, 308 bp, Homo sapiens
aaacactacatcactgcctactccaagccctagctccagtacgggaagtgaaccatgacaggaaatttaacatctacaggaaaagtagaaacacaattcttctaaaggtttatataactccaactaaggtcatctctttcttgccattaacttcctgaacgcctgtaatccagcactttggaggccgaggcggctgatcacgaggcaggaatcgagacatcccgctaaacgtgaaacctgctctctacaatacaaaactagccggctaagggcggcgctgtagccaactacttgaagctgagcagaga

SEQ ID NO: 9028 - DNA, 341 bp, Homo sapiens
  misc_feature 147, 148, 149, 150, 151, 152, 153, 154, 155, 156, 157, 158,159, 160, 161, 162, 163, 164, 165, 166, 167, 168: n = A,T,C or G
aggcctagcacagtggtgtggagttccagctactcagaaggctgaggtgggaggattgcttgagcccaggagtttgaggctgcagtgagctatgattgtgccactgtactctagcctgggcgacagagtgagactctatcccttttnnnnnnnnnnnnnnnnnnnnnnaaaaagcggccgttttttcctctgggccccgaaggggaaaattctttgggagttttgggacaccccacaattaaaagggggggaaaaagggcttttttttggaaaatttggagactttgttttttttttcccccttttagcgggggaaaaaaaggtaaaaccaaaattttttt

SEQ ID NO: 9029 - DNA, 388 bp, Homo sapiens
  misc_feature 146: n = A,T,C or G
cgggcatggtggcacatgcctgtaatcccagccactcgggaggctgaggcaggagaatggcgtgaacccaggaggtggagcttgcagtgagctgaaatcgcgccactgcactctagcctgggctacagagcgagactccgtctcanaaaaaaaaaaaaaagaaaggaaaaattgggggggcccggcccgggggcctaatcttggaattcaaaccttttggggggcccgggggggggggataaaagggcagggattttgaacccagggggcccggaggggaaaaccttttttttttttaaaaagaggggggggagaaaaaaccccattgggggccccttcccgaaatccggggcggtaaaaaacccttggggggtttggccaaacccaa

SEQ ID NO: 9030 - DNA, 72 bp, Homo sapiens
gatgggaactggagactaaagtttagccacagagacagtatgtgatcaataaaaattctgaacactgggctg

SEQ ID NO: 9031 - DNA, 590 bp, Homo sapiens
cagttactttcaaggctgaggcagaaggatcgcttgagcccaggaggtcaaggctgcagtaaactatgatcacaccactgcactccagtctggggtacagagtgggagcgcatctctaaataataatgacaatactaagaaattcagcaaatggatgtttcatatgtgtgcatttcattgcatgcaaatttataaaatctcaaagataactgcaaacattgaactccagttggtgatatgaatcctgaaatgtttaagggtaaagagtactgatgtctgctttaaaattctttaaccttctttaaaaatacatttttaaaaaatcagatgacttgatagaggaatggactgatagatgtgtaataaagtaaatacagaaaaatgttaacaattgtagaatctagatgatggggccaggtgcggtggctcatgcctgtaatcccagcactttgggaagctgaggcaggtggatcgatcacctgaggtcaggagtttgagaccagcctggccaacatggtgaaacaccatctctaccaaaaatacaaaaattagccaggcgtgacagcgcatgcttgtaatcccagctactc

SEQ ID NO: 9032 - DNA, 352 bp, Homo sapiens
gggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaagaagaggagcgggcactcccagggaagaccgtagcctgggcaaagatg

SEQ ID NO: 9033 - DNA, 505 bp, Homo sapiens
ctctctatacaaggggggtgggggggaagggtgcgtggaagaaagcctgggtcaagagctctgagaacgctgctgccctggcatcattacagcaatgacaaaggagcagaaccttcataaagcaaattagaaaacttcccatgctaccaggtagttcttttatttgtaaatgaggagtggaataattaaagaaaaatcacaactgcattcttagaatgtgaatttgctgatttaccaatagatacttattgattatgcaatatgtaccaggcattattccaaggacaagttgtaagcaggacagataagctactttctcttatgagtcttgcattccaatatagaaacagagataataaagaaataatgggctgggtgcagtggctcatgcctgtaatcccagcactttgggaggccaaggtgtgtgggtcacctgaggtcaggagtttgagaccagcctgaccaatatgatgaaaccctgtctctactaaaaatacaaaaatca

SEQ ID NO: 9034 - DNA, 323 bp, Homo sapiens
  misc_feature 323: n = A,T,C or G
ctactcaacatcgtgtggttctgccaagtaaaccacaaaatgcaaagaatccatgatgtgagacctgtgtttcccataaataagagataaaaataacatctaggctgggcctggtggctcatgcttataatcccagcactttgggaggcagaggtgggcagattgcttgaggtcgggagtttgagaccagcctggccaacatggtgaaaccccatctctactaaaaatacaaaaattagctaggtgtggtggtgcatgcctataatcccagctacttgggaggctgaggcagaagaatcgcttgagcctggaaggtggaggtn

SEQ ID NO: 9035 - DNA, 279 bp, Homo sapiens
gaaaagaagataatttaacattagatattgctaaaccgaaaagacagctttttgaggcatctcaggctcatctcagcctgttgcctggagctgatattcttactggagccgctgatggcctttctaacactaatcctttaaagtggattaaaaccataggtggatcaacaattgcaaattttattttggtttgtgtctgtttatgctgtttatttttagtctacagatgccgacggcgccttggtagagaagccagacacagcgaacgaaatagcaatg

SEQ ID NO: 9036 - DNA, 117 bp, Homo sapiens
cctggaaggtggaggtttcagtgagccgaaactgtgccactgcacttaagcctgggtgacagagtaagactctgtctcaaacaataaaaaaaaaaataaaataatttaaaaaacttt

SEQ ID NO: 9037 - DNA, 154 bp, Homo sapiens
tattaccctattgacctgccacatggtagagataatgatcagtaaatactgaaggaactcggagactggtggcggcagggggaaggcagggttcctccgtatgctgagcgccagtcccctgggcccacttttcttttttttttttttaattttt

SEQ ID NO: 9038 - DNA, 256 bp, Homo sapiens
cgaaaattcaccacttccacttaagatctgttgacattattttatgtatgtattcttccgtgaatttatttatttatttatttttttgagacagggtcttgctctgccgcccaggctggagtgcagtggcacgatctcggctcatggcaacctctgcctcccgggttgaagagattctcctgcctcagttttccgaaaaactgggactgcaggcatgtgccaccatgcccagctaaatgttttacgtttttagtag

SEQ ID NO: 9039 - DNA, 340 bp, Homo sapiens
agggcttgcacgataccctcagatgtttctgttctaacctacctgggctttaggctgagtacataagcaagtgagggttttctaacgatagaagaatgtctctgccacttggaagtcccaggcttagtgagaagcatctaccatagaggacaggaggaacacatttcccactgtgccccgggaggaagtgtcgcctcagcagcacacagtggctacagagctgcacacctggataaacccaggataagacaacgtttgccagacaaattctgtcgctggctctcccaccccgtctaagaatgtgtcctgttacattacgaaaagcaacacatcagaactg

SEQ ID NO: 9040 - DNA, 105 bp, Homo sapiens
tcgatgaggtgctggtgtgtggatggatgaggtgctggtgtgtgggtggatgatgtgctggtgtgcggatggatgatgtgctggtgtgtggatggatgacatgct

SEQ ID NO: 9041 - DNA, 205 bp, Homo sapiens
cacggtgctcagaaaacggtaagaataaaataggtatttactactcaggacatagtacagagttattgtatatttattgaactgaattgagctgtctagtttgccctttaaaaccaggtgttttagtatttggaaatatggacaatgatacctttggtgttccttaaattcaccagattcgtgatcatattctccaactaaattc

SEQ ID NO: 9042 - DNA, 511 bp, Homo sapiens
catatgttcctccaagtctaggaaccattgccataaatatcaaccgcctcttcctcgtgagaccacagtaactatgggatgatacaataagggcaagatgaaagatcaaagctttggtgaaggaaagataatggaataaaagacacggctgtgtatcctgtaattaccactatacaaacaggcatcagctttatagtaataatcgtagagcatttattctgcacttcctatatgccaggctttttactcttttatgaacaacatctcacttgtcacagcttgaggctgtaagttgaattatgtgttgcttactaaagatactggaaattatacatcaaaattcattttggctatgtttagatagtatcaaaatggggtattttccaaaattagcaaatatagttttattattggtaataatatcattaataaaaacgataaacagaactgacaaaagtacattcaagaaatatcaggccgggtgcggtggctcacacctgtaatcccagca

SEQ ID NO: 9043 - DNA, 126 bp, Homo sapiens
ccgcttgggcgggcggccagtggcgactacagcagggactggctgccaacccctccggctacgggccccttaccgagctcccagactggtcatatgcggatggccgccctgctcccccaatgaaag

SEQ ID NO: 9044 - DNA, 591 bp, Homo sapiens
ctctcctttgtccttgggcctcttcgatcacttattgtaatcgtcatttattgcaattgactacttgcgcctgtagtcccagctactcaggaggctgaggcaggaggatcgtttaagcccaggagtttgaggctgcagtgagtcataatcgtgccactgcaccccagcctgggcaacagagcaagaccttgtgtctaaaatttaatataaaaattattttttatattaaatcatggaatatttcaaacatacagaaaaccttgtctcctgtatgtctcctatcatgccccttgatgacagggacacagattcattacttcttctgtgccccaatcctcagcctagagcccagcccagattaagtgttcagtagaaaaacaaaacaaggccagatggggtggctcacgcctgtaatcccagcactttgggaggccaaggtgggcagatcacaaggtcaggagttcaagaccagcctgtttaacattgtgaaaccccgtctctactaaagacacaaaaaattagctgggcgtggtggcatgcccctgtaatcccagctacacaggaggctgagggaggagaatcgcttgaacc

SEQ ID NO: 9045 - DNA, 535 bp, Homo sapiens
tgcaataaatacgttgcatgctgcggaggcagggaaggcattcttctgcatgttgtgtcctgcagtggagggaaaggcattcttctgcaggatgcatgctgcagagaaggagggaaggtgttcttctgcatgttgcatactgcaggggggaaggcactcttctgcatgttgtgtcctgcagtggaggaaaaggcattcttctgtaggttgcatgctgcagagggagagaaggcatttttctgcatgttgcatgctgcagaggaggagggaaggcattcttctgcatgatgcatgctaatccatggacatggaggccatgaaagaggaaggaagaggcagtaacaatgggtactccaatcgcacagcttttcaagcaagtgttgtttgctttattcttttcctttcaaaggagagagaaaacccaaaaccacctccaattacaatatgtggaagatgaaataaaagaaagtcaagttaatttgtggccttttaaaaaaacaagaggttgagcatggtgtctcacacatgtaatccc

SEQ ID NO: 9046 - DNA, 542 bp, Homo sapiens
gtaaataaatacttcaattctgccaggggaggtggctcacgcctgtaatcccagcactttggaggccgaggtgggcagatcatgtggtcaggagtttgaaaccagcctggccaacattgtgaaaccctgtctctactaaaaatatgtgttttagctgggcatggtggcacatgcctgtaatcccagctactcaggaggctgaggcaggagaattgcttgaacctgggaggtggaggttgcagtgagccgagactgtgccactgcactccagcctgggtgacagagcaagactccatctcggaaaaaaaaaatcaattataattttgtttacatgtattattacacaaaatggtccattattcagaagcctcccatttgaggtaatgattggtattattaggatcttttgatgaaatcttggttgaattgatgataatatgtttttaaaatatatagatgtttttatttcccaaataaaagaaataaagactctttacaatttaaggagaatattagagaatttttaaaataggtcaggcacg

SEQ ID NO: 9047 - DNA, 525 bp, Homo sapiens
ggactccaccagtctgaccttagagccccacttttaaccctgtttacccagggcccccaggtacttcaaatctatattttgggccctgagctgttgcccacatttcactcagaatgtaatactcagaagcctgactgctttgtctctaccttgtcttcctggcttctgtaatcatttttcccctttttaaaccttttactttgaataattcaaatttatagaaaagttgcaataactggccaggtacagtggctcatgcttgtaatcccagcactttgggaggccaaggcgggtgtatcacctgaggtcaggagttccagaccagcctggctaacatatagtgaaaccccatctctactaaaaaaatacaaaaattagctgggcatggtggtgagcgcctgtaatcccagctactcaggaggctgaggtaggagaattgctcgaacccagaaggtggaggttgcagtgagctgagatcgcgccactgcactccagcctgggcgacagagcgagactccgtctctc

SEQ ID NO: 9048 - DNA, 463 bp, Homo sapiens
atcttggggaagtttaaagacacctggagaatgaaatcttggattttactttcctgaaaggctgaggctaggcataattctctgcctttgttcccctcctttgtcttggttaaatgttcctggccatactgtacctgtggttttattgtcgtcctttttgggaacaagcaggatataaatcagtcagtgaaattttagaatgtagctctttggtctagcatctaagtagataaagaagaaatgggcacttaataagtgcctctggaggcttgtgatttgcatggggctcccaatgaaaggtaaagtctttgcttagaggttacacacaccgaatgcagggtggtcctcaggcctctggtcacagcatgcacagtgctggtgcctcgatctgcaaacctggtgcgcgcagccgctggggaccatctgccccaaggccaccccaggacttatcagaaaggagaag

SEQ ID NO: 9049 - DNA, 129 bp, Homo sapiens
cactttgggaggccgaggcgggcggatcacgaggtcaggagatcgagacgatcctggccaacacggtgaaacccccgtctccactaaaaatacaaaaaaaaaaaaaaaattcacccggggggggggggg

SEQ ID NO: 9050 - DNA, 600 bp, Homo sapiens
cattatcttagactatctagactaaaatgccactcaaaaaaaatcaaaaaataaaaaagtgaaaatactgtccttttcatttaattacttatacctacactattattaagacacaacaaattttgttttccaaataactagctgtgggaaataagagaggagaatattacagattatcagaaagaaacaaagcaaacaagaatgattaaatattagtacacaatttgacacattttctgtattaaaattttatgtctaatatctggatttaaaaatttatctcaacaaaatattctttcataaagagttttagatggctgggcatggtagctcacgcctgggatcccagcactttgggaggccgaggcgggtggatcacttgaggtcaggagtttaagaccagcctggccaacatggtgaaaccccatctctactaaaaatacaaaattaggtgggtggtggtggcgcatgcctataatctcagctactggggggctgaggtacgagaatcacttgaacctgggaggcagaaggcggaggttgcagtgagccaagatcgtgccgctgcactctagcctgggcaagagtaaaactccgtct

SEQ ID NO: 9051 - DNA, 340 bp, Homo sapiens
atcattagattggagagccgccaaacacctaaactatatgaagctaaagtctgtttaagaaagagcccatccaggctgggtgtggtggctcatgcctgtgatcccaaaactttggggggccaaggtgggtggatcatgaggtcaggaaatcgaaaccatcctggctagcatggtgaagccccgtctctactaaaaatacgaaaaaataattggccgggcgtggtggcgggttcctgtggtcccagctactcaggaggctgaggcaggaaaatggcatgaacccaggaggtggagcttgcagtgagccgcgattgcgccactgcactccagcctgggcgac

SEQ ID NO: 9052 - DNA, 602 bp, Homo sapiens
aactaaattactgtattcttcaactaatgggacacaatattcttttttttcttttttgagacagagtctcactctgtcgcccaggctggagtgcagtggcatgatctcagctcactgcaacctccacttccagggttcaagctattctcctgcctcagcctccaaagtagctgggattacaggcacgtgccaacacgcctggctaatttttgtattttcagtggagacggggtttcactgtgttagccaggatggtctcgatctcccgacctcatgatccacctgcctcggcctcccaaagtgctgggattacaggcatgagccaccgcgcctggccgtaatatcctttttttaatcccacttggaaatcacaaaggaagcattactaaattatgatttaattctgcatagttaatggaaaaatattttgccatgttttcaccttattacattttctcaatatcagacaaagacctgtttttttcccattaccaaagttgtggatcatttcacgtattttaaatggatttaatcctcattaactgagaaatacagttacctagatcctctatgctatctaaaatattgaccaaaaaaaaaaa

SEQ ID NO: 9053 - DNA, 492 bp, Homo sapiens
ggcacgagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaacatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttac

SEQ ID NO: 9054 - DNA, 524 bp, Homo sapiens
tcgaattcggcacgagggcagatgttcttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgcgtttgacacaggcttgcgggacgtgcagccctacctgtacaagatctccttccagatcactgatgccctgagcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttct

SEQ ID NO: 9055 - DNA, 183 bp, Homo sapiens
ggcacgagacaaaatgaagctttaaaacagaaaaaagaaatctacaattccccatttaagtaggctgttaaatccaacatttaaaataaaaattaagctatttcttttgggtttcccacaccacttttacctgtactgattttttttcttcttttttttttttaaaaaaacagggttttgttt

SEQ ID NO: 9056 - DNA, 413 bp, Homo sapiens
ggcacgaggaaaagtccaagctcgtggtgggtggaaaagtgttcgccgaggtgtgcatggtttcccagccacgtccctgttttcaaagatagtttcactttggtctctgaattgaaatgctgtctactgaaagggtttcaggatcgtttatgtaaggggctgtgatgaaattgcattccccatagataaaagaaaaatcatttctatccagatatctgagcacaaggattggcttgttagtttaacacatccgtatttttggacattcagtgttacttgctgagtctgacagcctctgggcccggccaggggccctgttaacaaactgctttcacatcccaacagggtctgcttggccactcattgcatctgcgattaaccctaaaggctttaaggaacgggccacctgtgac

SEQ ID NO: 9057 - DNA, 431 bp, Homo sapiens
  misc_feature 313: n = A,T,C or G
ggcacgagacaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcaaagaggaggccccgcctggggaccggngtgcaccgcttagctcggcccccattctaaggggctggtttggcaggggcttgacaaaacgcacaaaaaggaagaaagtgacgtaatcacgtgctcgatgaaaacaagttgcactttt

SEQ ID NO: 9058 - DNA, 300 bp, Homo sapiens
cttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggc

SEQ ID NO: 9059 - DNA, 499 bp, Homo sapiens
ggcacgagcttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatgaatgactttgctatggtttttcaagtgtttatagtaaatatgtccatttgatggaaatataaatatgcattaagtgtaagtggctaggcacaccctgctgtcactttttatggtaatcagtgtctttcactttctgttgtttttaatagggaccagctgacaacgccacattaaaaccacagggactcaaa

SEQ ID NO: 9060 - DNA, 436 bp, Homo sapiens
agatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgta

SEQ ID NO: 9061 - DNA, 431 bp, Homo sapiens
ggcacgaggcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagca

SEQ ID NO: 9062 - DNA, 405 bp, Homo sapiens
cgttgctgtcggaacatttatattgttattctttgtggctattggtgtgtctcacaggcaaaagttgatttggctaaaataggctcagatgtatttgcgtgcccgcgtgtgtgtgtgtgtgtgtgtgtgtgtgtgtgtgtatgaaagagagagagactttgacgggtgtagatattttttgcgctttgcctactatatgagtgataatcatgtgtttactaacaagtcgatgacctggctgtattcataataccatttaatattggcgtgagtgttctcgcttgacaaaaagaggcctcccctgcttctttcaacaactgtcacagagtgggtgggctgaaagctctgcccacggccctgctattggcgagagaggtcttttgtgggagcggtgtctcgtgcgtc

SEQ ID NO: 9063 - DNA, 93 bp, Homo sapiens
ggcggacccgatgaaatggaggtttgaccatttttcacaagaatggctgtttcccatgcccaagttagagtaagtgctaatgcatgttggaat

SEQ ID NO: 9064 - DNA, 371 bp, Homo sapiens
atggtgaaaccctgtctctactaaaagtacaaaaattagccaggcgtggtgacacacaccagtaatcccagctactcaggaggctgaggcaggagaatcacttcaacccaggaggcgggggttacagtgagccaagatcatcccattgcactccagcctgggtgacagaatgagactccgtctcaaaaaaaataataataaaataaaatgaaatcgagagatctacatgtacatggtcacctgacttattataatagtgtcactgcaaacaagtcagggtagaatggtcttttgaataaatggtagtaggtcaattacatacccacatagggaaacatgaatcgtgacccgaccacaccattaatgaacat

SEQ ID NO: 9065 - DNA, 489 bp, Homo sapiens
gtgagtgcctgtaatcccagctactcgggaggctgaggcaggaaaattgcttgaacccaggaggcggaagtgagctgagatcatgccattgcactccatcctcggcgacacggtgacactccttttcaaagaaaacaaaaaacaacaaaaaacaaaaaaaattctacattcataaccctctagagtcatatactttaaaacaaaacaggctgggcgcagtggatcaagcctgtaatcccagcaccttgggaggctgaggcgggtggatcacgagttcaggagatggagaccatcctggctaacatggtgaaaccccgtctctactaaaaatacaaaaaaattaggtgggcgtggtggtgggcgcctgtagtcccagctacttgggaggctgaggcgggagaatggcgtgaacccgggaggcggagcttgcagtgagcagagatcacgccactgcactccagcctgggcgacagagcaagactctgcctc

SEQ ID NO: 9066 - DNA, 164 bp, Homo sapiens
ggaattgtagaaagatccagaaatgcagcccactcccagagattcctaaattggtctcagatggagtctgacccatctctttttatacgttcccccaaatgattctaaattgtggctagaaaagagaaccactggccgggcgcggtggcttacgctcgtaatcc

SEQ ID NO: 9067 - DNA, 308 bp, Homo sapiens
ggaccattatttagctaccattggttgcctaatctagtttggaatcgggaggaagggaatgtcagagacaccttcctgaaggagttgatggctgaacccagaagtgaaggtggctgggatttaccctggcagaaaactggggatgaacatcctaagtgggaaacatttggggtggacagagtgacggtagacgaatcacagaaactcagacctgctaaggcggtaggatattgttaacgtgcaacttctcatgttgttttcgcagacatagctgacatagcatccaattattattctttaatttcctc

SEQ ID NO: 9068 - DNA, 290 bp, Homo sapiens
tacggctgcgagaagacgacagaagggaagataaaatttgaaatctggttaggctggtgttagggttctttgtttttggggtttggcagagatgtgtttaagtgctgtggccagaagcggggggaggggggggggtttggtgaaaattttttgttatgatgtctgtgtggaaagcggctgtgcagacattcaattgttattattatgtaaaaaaaaaaaaaaaaaaaaaaaaaaaaaaaaagggggggcctttttttcggtaaccccaacctgaaaaaaacctttggggg

SEQ ID NO: 9069 - DNA, 368 bp, Homo sapiens
gaaggggagccatggaatttttccggtagtccccaactttacccccactgcttctatctttgtggctttgccctcttttatcgcctaataaggctggatagcactttgattcctcaccgtctaacacacggcactttaattttgaggatagagaatggctaacataaagtattcctataatttattaggcttactgtattgtatgctgtggtcacttaaaaagaggactacaatactatatataacacattcagaaatgttgtataaagaccctttttgaattcataaatcttttcttatacagccagattatcataaaatgtatgtgtgggtcgagcgcagtggctcacgcctgtaatcccagcact

SEQ ID NO: 9070 - DNA, 593 bp, Homo sapiens
ttgtccagttcctttgctgggaagagacctactccaaaaactccaagtacagattgcttttgggccacaaggaagtatgactttgagcctaactgagctgaaggccatgatgttaacccttactgtcccacagactgaggactggagactatatgcaaaaaagactccagaaccaggagtaaatgaaatgtatcggttacttactaaaattcctggagtataggctgaagataactcaccagggctggctgtaaatcaggcactggtagtagtagggtcagaaccaggaggcccccttcattgctgtggagatatagtagataaggtgttctcaagccagagagattttacagaccaacccctcagggccccagatgttgaatactttacagatagaagcagttttgtactggaagggatctgacaagccgggtatgcagtagtaacattaaactcagcagcagaggtacagtctctgcccaccggaacatcagcccaaaaggcagaactaatagccctgacaagagcccttttgctagcaaaagacaaaaaaagtcaatgtctggccagtcacggtggctcacgcctgtaat

SEQ ID NO: 9071 - DNA, 426 bp, Homo sapiens
ttatacaaatcaataagaaaactgcaaatgagaaaattatatcaagcagcaacgctctaatgaagaaataaaagtagccaacaaaaagttagaaaatggccaggcacggtagctcaagcctgtaatcctagcactatgggaggctgaggcaggaggatctcttgaggtcaggagttcaagaccagcctggccaacgtggtgaaaccccacgaggtgaaaactgtctctacaaaaaaatacaaaaattagtcagacgtggtggcatacgactgtaatcccagctacttgggagtctgaggcaggataatcacttgaaccaaggaggcggaagctgcagcaagccgagatcacgccactgccctccagcctggtgacagagtgagactctgtctgaaagagacagagagagagagagagagaagaaag

SEQ ID NO: 9072 - DNA, 545 bp, Homo sapiens
tcaggttcacagaactgcagcatttcctctgaggttctgttgtttttatcaataaaaagctaagggcattacactgcattaaaatgtcaaatagcaaggatatttcctcaggttttcacggacaaacatattctataaagttagtttgatgtcttaactgttgcacctatctgaaaggatacttgagacaaaacaaaaatttttttttttgcctgtcacatctgatgttatagacaactttgaatgcaatcttagtgtatgggatgacaatatttaatattgctcgtttgatttaaatgatttgcgagtaaaattcttcaaaattaagagaaaaaaatcagccaacaccaacattttggtgctttgtctttgtcaatattctcatcaaattctttaacttcactgtattattctcttgagaagaatctatggtcagactagttttcaaatatggttctacttctcatttttgaacttgggactttagctaccacctctgacactcagtgttcttacacattaaatgagatttatactagtaagac

SEQ ID NO: 9073 - DNA, 355 bp, Homo sapiens
  misc_feature 27, 28, 29: n = A,T,C or G
gaaaataatatgtatatgctgtaatgnnnccattacccttcatgtgaacttataattgacatttgtctctaaaagcagtcaagcattcatctgtcatttcagttacactaggtaagtatatgtaaataggtgcaaagaaaagtttgatgagtcatatttatagaatatgttctgagcaaatggcagcaactaattacatccaacttatcgttggtgttcaattttgtctttcaacagcaatcaaatctcaaaagtctatatatacaactaagtctgccacaaggctttgccatagctgatacatttatcttttaaaatagtaattgggcctggcacagtggctcacacctgtaat

SEQ ID NO: 9074 - DNA, 615 bp, Homo sapiens
agagggcttcttggaggccaggcatgaactgagcttttaaagataaatgggagttgcccaggtatggtagactgtcacatcaatggcctccagtgagtcatgcccccccccgcccggtgtccatgcttttgtgtaatcccttccgtgctgattctgggcttggccacgtgccttgctttggccaatgggccatcagcaaatgtgatgaaagcagaagcttgtgaaatgtttgtacgttggagcttgcttttttggagttcagttgccacttgagggagtctgaactatctcagtttacatcaatcaccatttgggatctgccagcccccagttgacctaccatgggaccacacaggcctgtgacctgccatgggaccacacaggcatgtgacctgtcatgggaccacaaaagcatgtgtaattccaagtgatgccatacagaagagaaatgagccacccagataaggctaccgtggtgattctaaaatgtggacacaaattctttgacattccttcatcaagaggtgacatctaggccgggcgcggtggctcatgcctgtaatctgagtactttaggaggctgaggtgggcggatcatgaggtcaggagatcgag

SEQ ID NO: 9075 - DNA, 436 bp, Homo sapiens
aaagatgtagatgcagacatgaaaatgcatgcaaatacatacacatgtagataaatatagataaagctatcaaaggcatcttcctttcaatcttcttttgagtataattcggaatttatcctgagaaatactgataaaatatagggctaggcaaatataatttgggatgctgtagagtgttattagtagaaacgacttctcttttctgagccttgtgaaatagctttcaaggggcagctggtagtgatttaagggcagtcacagagacagccaattagagttaatcagtcattatatttacagcatcagactatcatgcaatacaaaacggatgccgacttgaccttttcatcccctatatttccttccccatctcaaacagcagccaatcttatgcaattggcttcattatgaataatgggaagcatcttacatt

SEQ ID NO: 9076 - DNA, 570 bp, Homo sapiens
gatttcatgtttttgaaagatgaaggcaagatttcaatttctatcatggctcattctgctttctagggacatccatcttttaagccatcagatcatgctgtttctgtttgaagtccatctcaggtactgcttgacatgtacagatgctgaagcactgcccctttctaagggagggggaaagttcttatcaggtactctgccttagcagctccccttgccttcccaacctggaccatccttgccttattctcatcttcatgcttgtctcctggctaatctcaattccattttgtgttcatgttcgactggtgttatgatcctgatatttgcaagaaaagaagattaatctacactataaactctatgtgagtaggagcaaggtctgtttgtatttattattgtataccattaccattaccattaccattacctagcagtacctgttacatagttggtaagcaaaaaggtaaaaaaaaccagacaacaatgggccgggcacggtggctcacgcctgtaatcccagcactttgggaggccgaggcgggcggatcatgaggtcaggagatcgag

SEQ ID NO: 9077 - DNA, 553 bp, Homo sapiens
tcctatttattttccataaatgacatgacaaaaattctttattgcattggggtgcgagtggggatgtgaacgggacgagggacgaggtataaaactagttattgcacactccaaaagctctgatttgaaaatatagtttaagccctggtttacagaaacactttaaaactctagtcttaatctagctaaagctccttaccatcttggcaacaaaagcaatttgagcaatttgagcaaaaccataatctaatttaacctaaagcttgtaatatgtatctttgcattaagtaagatgtgtagttttaattactttccttaagttagaaagtagggcccagtgcagtggctcacgcctgtaatcccagcactttgggaggcctaggtgggcagatcacctaaggtcaggagttcgagaccagcctggccaacatagtgaaaccctgtcttcactaaaaatacaaaattagccgggcatggtggtgcctgtagtaccagctactcaggaggctgaggcaggagaattgtttgaacctggggaggtggaggttgtagt

SEQ ID NO: 9078 - DNA, 446 bp, Homo sapiens
aaacattagagacaatcctattaaagttaggaataagataattatgcatgctattaatgttgttatttagcattgaactgaaaagctctagccagtgtaataagacaagaaatattaatattgaggagaaaaaaatatcattatttgcaaaattattgtctacctgaaaataaccctaataaataaaatgtacttacaaatcagtgaagaaatgaatacaccaatagaaaaatgagcaaaagacataattgagcaattcacaaaggaagaaaaacaaatggtcaaacaaaacaaaagtaaatagtccatattgggctgggcacagtggctcacgcctgtaatcccagcactttgggaggctgaggtgggcggatcatgaggtcaggagttcaagactagcctggccaacatggtgaaactctgtctctaataaaaatacaaaaatc

SEQ ID NO: 9079 - DNA, 180 bp, Homo sapiens
acacagtaaaaaacgataaagcaggtatcagcactgaccttatagaaatgcaatcatcagggctgggtgtggtggatcatgcctgtaatctcagcactttgggaggccgaggtgggtggaacatctgaggtcaggagttctagaccagcctggccaacaaagtgaatccccgcctctact

SEQ ID NO: 9080 - DNA, 396 bp, Homo sapiens
ctttagcaactaacacacatagcagctgaggactggcttcaccagcctcctaaagagaatctgagcaagaaaccacagcatccaccaaacaggctgagtgtggaattaaaaggaaagaaatgaagaagaagaaaaagaaaggcatgatgtctaaaaacaaagagctacaaaaaagaaagaaaaacatggaagaaatgtgaggggaaaaaaagaaaatacaaggcagttttttatttccaagggctaacagaagatatccttaaagacaacatgcataatacatttagatgtgaaagaaacaaaatttaaatgaatgagaaaggaatagttaggttaagcttcttggtgaaagggatggtttagtcaccatggtttacaacgaccctgctgggcact

SEQ ID NO: 9081 - DNA, 454 bp, Homo sapiens
gaccctaacctctctttgttctcctagacccagtgggtacaagctgcttcctacacttattacattacctcaggttcctgtgtgctgtcagccctgtgtgtagcacccacactccttctgatcccttcagcatcttgtgcacacaggcttaccgcgtgctttcacagccagcatctgtgctccctcgtatgtgcccagagagtgagaagtgcctgacaattcttgtccgcccgaggcagccatgaataaatgaccatggaagctttaacaatgtagctcccttgcctctgatcaggatgactctgagagatgtgacctacactgtctccagagctcccctgtggggctgtgccagagtcaccgtccatggattcgcttttctgatcctacaacttcactcccctcccagttttccctggagtgtcttcctaataaactactttcacatggattc

SEQ ID NO: 9082 - DNA, 589 bp, Homo sapiens
acttcaacttgggcaaaatgcatgctcacgtttgcaaccacctcccatatgtcattgcactgtacatctgaatcttcaccccagctccctttcagcactgaagtccattttggatgtctgttgattgagggagccacctgcattttcctcaggcttctcagagggagcacagacttcacaaccttcattatccacctcccaaaccagctctttgatctgggctcctgacctgttagtagcacatctaaacgcagtagaacaggcacgtcagtcattcttgctccactgcctttcccctaatttccagttagtcgattcttcatccaaatagctttcaaatttttcccctctctttcatccccacctgtctctttgccttctttcagactttctccagacatccttctagccaaactgctttcagagtgacctgtctgcaaatttgtcaaatcattcctatattaaatcttttaaatgacttgccattgctcaagttgtacatagagagcttattttaaaagcccaggctgtgcgcagtggctcacacctgtaatcccagcactttgggagtctaagcaggcttgatcac

SEQ ID NO: 9083 - DNA, 416 bp, Homo sapiens
agatccaaccttgctctaatatgacttataaaaggcttacgggaaatatggctggtttcactgttaatgattcccctctcctttcttccctctcttcatagcaggctttattgcaagaaaacttacaggaggcaaagtgttcaagtgtaaagaacgatacactgactatccagatatgagaataatttactctgtttccttgaagagattacaccacaaaatagataagttagtaggtaaagaactgctttcttccaaccaaaaaaaaggagaaaggtggtttttagtagttttagttttgccaaaactaccgaagttgaagacttcccaaaactactaaaggaagactgaagtggaaggactgcttgaggctaggggtttgagacccggctgagcaacatagcagggcagggagt

SEQ ID NO: 9084 - DNA, 594 bp, Homo sapiens
ttacaacagctctcatttattcagaccttattctgtcccaggggccgggccaagtactttatgtgcattgtatataaattaatcttcctagcaacctcatgagacagatactattaccaccttcattttatggataatggattaaaagtcaaagtggttaagtgacttcctctttgtcagtggagaaccatccagggttttacaactgcagagcccattaaaccattgtcgtatactgttgatccttgttctcacagatttcaacatgttgggaggatgacatagaaacctgaaactaagcatacagggaagtgggctctagcctatttgaaaaggctctggagggctgggcgtggtgactcacatctgtaatcccagcactttgggaagccaaggtgggaggattgcttgagcccaggagtttgagaccagcctgggcaacatggtgaggtcctgtctctattaaaaattaaaaaattagcccagcatgatagtgcatgcctgtgatcccagctactaggtaggctgaggcgagaggatcacttgagtctggaaggtccagtctgcagtgagccttgatcacaccactgtact

SEQ ID NO: 9085 - DNA, 574 bp, Homo sapiens
taccattagcttttttattgggtactatcctttgactaaatgcccatgtctatcaaagtgatgacactcaacaagcacaagcacttctctatttattcattcttaccatgtactcattagaattagattaactttaaaaaaaatgtaattgatcctatcataacaacatatacaataggtgagcatatgtactgtttaagcaatatagctaataatcattagaactctatttgtaagccccacaattatagtatctcagtaacatttacatttaccattattttccattagactttcccttattctagcaataaatttcatccatagacacaaaaattgaaatttaaaaattttaaagtctcagtaagtcattcaattccaataccattatacattttatgcttaataattatcaaactctttatagactttgttgtttcaatcgttttaatagtaattacaataatcctttctacacatttttaacacttagagctttatgagcaaagatactaaaatataaaaaatgctaagtgctggccgggcgtggtggctcacacctataatcccagca

SEQ ID NO: 9086 - DNA, 580 bp, Homo sapiens
gaaaccccgtctttactaaaaacacaaaaattagctgggtgtggtggtgcacacctgtaatcccagctactcaggaggctgaggcaggagaatcgcttgaacccaggaggcggaggttgcactccagcctgggcaacaagagcaaacctccatctcaaaaagacaagacaagacattacctaataatgtcttatctagtggtaattattaggtaatgtcttatccagcgagtcctttctctggcactgattagttaaaaccctcagaggatcactcagttttcaaaggtctcacctcttcctatattaaatcattattaatccttgcattggtcaagaaaagtttttaattaaacaaaaggcagaaaattataataaatgattgtgaattgtccatttgttactcactgagcttaacagatccttccattcccaaaagtacattgtcacttttgatgtctctgtggatcacttgattagcatgtaaaaactccaatgcctgtaaacactgaacagaagaaaaacacctattaatgaaatagtccctgaaaagacacagggaggcacatgcagtagctatg

SEQ ID NO: 9087 - DNA, 437 bp, Homo sapiens
tgtgtagacaattgtagaatttcgagctaggagtagaagagaactaatgctgagattcctttctgttaattttttttcatgattctgataaaactcaggattctctcctcagaaacatgtacacgtaaaattttgcatataaattttggggcttggccaggagcagtggctcatgcctgtaatcccggcacttggggaggcctaggtgggtgaatcacctgaggtcaggagttcgagaccagtctggccaaccttggtaaacctcatctctactaaaattacaaaagttagccaggtgtggtagcaggcacctgtaatcccagctacttgggaggctgcggcaggagaatcgcttgaacccgggaggtagagattgcagtgagctgagactgcgccattgcattccagcctgggcgacaagagtgaaactccatctc

SEQ ID NO: 9088 - DNA, 559 bp, Homo sapiens
aacttttcttcctctcctcacagaactttcactttaattggtaagtgttaaatatctttggatctccctttcaccatctgtaaaatagctacttttcaaggttgctagtgagatttataaataataatgtagggggtatatctcttatttttaaactagctttctttataaacataaaatatttataaaactaaaggttggaaaacacttgtatagtacttaagaggacaaaatgatattcatgtttctgtgttgaaacaggttacttttatgttaggttaagacaatcccagttgggttatgtttccaagcaatttcacccctaaaatgtataaacaaagtgtttcacttttcacctgaaatgtcacttctaccattaaatgccccttcctttcaaaagaactttcatgatgtagttgaaagtgatgggtcgggtgtggtggctcacgcctataatcccagcactttgggaggccgaggcaggcgtatcacctgaggtcaggagttcgagatcaccctggctaacacggcgaaacccgctctctactaaaaacacaaa

SEQ ID NO: 9089 - DNA, 476 bp, Homo sapiens
  misc_feature 408: n = A,T,C or G
atgtaatgaaaagtacaaaattgtaataaaatggagaattgtaaatgtaattttcattcatttataattaattcctttaaaaggttacaaaaattgttaagaaattgacatctatataaatgtaaaattaagtaaatatttgtacattttcttttagtttgttttagccagttttaattacttgagattatactgggcgtgcatgtgtgtgtgtgtatgtacatactcataaaatatacatctatacacatacatattcttccactatcactatgttgtgatcattttcccatgtcatggaactgattcaaaatatgatttttaattactgtatcttattgcctcttatagaagtaccattacttacttagcctttcttcagtaggttgtttccaacatttctcttanaaaaaatgcacctcatctgtaacgagaccaagaaaaaacattaatttgttcattttaaaagcttattt

SEQ ID NO: 9090 - DNA, 458 bp, Homo sapiens
tttgataacaattaagagtgggtttccaggttccttgggactctattttagtgttcgtttccactccagattagacctttccaaatactctcagaaactttagatgtcctccaatcaaactctgctctcttgaaaagactgccagcagtcttttatacctctctatattgccattccagaaatactggtatttggggtcatgtttctaactagggaattgagagttacagatagcataaggagtagtataaggatattgcaacaaggattttgtaaaggatccctgagtaagggatctcaagccttagatggaagaaatatatcatgtttgcatgtgtgttagtgtgttagtgtgtgtgtgtgtgtgtgtgtgtgtgtctcatccagcttgtggccctatgagccctgtacagaaaatggtagaggctgagaacatagacattcccacatttaataat

SEQ ID NO: 9091 - DNA, 70 bp, Homo sapiens
gtctcctgtcttccttctgtttctcccctcttccttcttttccttctcccccacatgaatctaaatgtgt

SEQ ID NO: 9092 - DNA, 137 bp, Homo sapiens
agttttcctggtttggatgcagcaaccaagaactgggtttaacagtactgaggtcaagagattatttcacggtttaacaatgttcaatattagaatgctatccccacagcaaatctaaaatatagtcctgacctggg

SEQ ID NO: 9093 - DNA, 436 bp, Homo sapiens
tagtactttcttggatggctttggtcatcttttcactcaataaatacatagagactatgggatccatgccagccagtgggaatcctgatctcatggggttcatgttctagcgagagagacacacacttactaaataaataataaaaagaattacagatggtgacaaaatctctgaagcaataagcaggatgcaggcagtggggaatgggagatatttgaggagggatttcactttaaatggaacagctagggagggcctctctgatgtagtacattttcttctgagaatgtgaaggatgagaagcagccagccatcaagtactaatagctaacatcattatttaaaattgttattaaaacataattaatggccaggtgcggtggctcacacctgtaatcccagcactttgggagtccgaggcgggcagatgacctg

SEQ ID NO: 9094 - DNA, 509 bp, Homo sapiens
taaatatttgcttaaatgactttttctcttctaattgctgatcacaatggatctcaaacttttaaaaagtatagcacacttttcgtcagtaaataaataatgaaattaaaattttagcaaagcagagatgctattctggtcgaaggggtttgtgagtacagcctggatctccaacctccatgacctccaggaacattctcacaggtcctgagagattttgggatattctgtggatcagaaaaacaattagtagcagccacctctaccaagggaattctctgcataacagaatgttgttaagttttcatatgcatcatcattttgacactcatattattataagatttattattgttattattagtttcagtattagtatcagcattatcatcccccttctgcagaagagtacacaaaggctgaaaaggtttaaatatcttccttaggtggtagagcctgaatttaactctaattagtttgactctgaagccatcattcttaaccatcat

SEQ ID NO: 9095 - DNA, 545 bp, Homo sapiens
tggtcttttggtttttgttgtgttcatttcacagcagatcagtgagcgtgtccttactgcctggccccagttcaagtcctggtgttagtgcttcggctttgaagtcagatgacctggggtcaagcctgtgccttgccactgggtggctgtgtggccttgggcaagctatttgctaaactttctgtttctgcatctatacaaagtgaataagactgaaaccttcccttcgtaaggctgttgaaggccaggcgtggtcactcacgcctataatcccagcactttaggggaccgaggtgggaggatcgcttgaggccaggagtttgaattcagcctggcaaacatagcaagaccccatttctacaaagaaattaaaaattagctgagtgtggtggcatgtgcctgtagtcccagctactcgggaggctgaagtgggaggatctcttatgcccagtagtttggggcaatagtgaaccatgatccactgcactccagcctgcatgacacagtgagatcctgtctccaaagcaaggaaaaaaggctcttct

SEQ ID NO: 9096 - DNA, 626 bp, Homo sapiens
gtatccgtatgatccatatgaaaaacaaaagtaaatcttgaccccttcttcacagcgtaaacaaaaatcaattccagatggactgcaatctgatatgaaagactgttacaatagacttttagaaagaaacactgaacactgtcttcacagggagtgtctggaaaggagctgagggtactttcaaggagctgctgatattcctgattttgatcttactaaacaaattataaaatgatttcaatatatgtacccacgtaagcataaattggtactttaagacataatactgaaaaccttttacaaaaagttttgcagaaagaaagggtcctaatagcaaaggaagttcaggccgggagcagtggctcaagcctgtaatcccagcactttgggaggccaaggcgggtggatcatgaggtcaggagatcaagaccatcctggccaacatggtgaaaccctgtctctactaaaatacaaaaaattagccaggcgtggtagtgggcgcctgtaatcccagctacttgggaggctgaggcaagggaatcgcttgaacctgggaggctgaggttgcagtgagctgagatcgcgccattgcactccagcctggctacagagcaagactccgtctc

SEQ ID NO: 9097 - DNA, 344 bp, Homo sapiens
tatcctcttttatacttcattgagaccaccagtaactgatgtagccacataaggagacataggttataaactagttatcttttaaaaggctcagcaacacaactcttgaaatgcttatcaggataatggtagctatagctgtccatttagaggaattctaggacagtgggagctgtgctactagcactatataattgcggtcagtgctgacaaataacatttaacaagtattgcagtaatcatcacttacaggtaccatttatttcaaaacaactttttttgtctgctccaaagttaaaataattaactagctaagcattattattcgactggtctaaaaacta

SEQ ID NO: 9098 - DNA, 578 bp, Homo sapiens
ggggataccccgaatttaaataaaatcgagttgtattacagttagggatctctcagttcccctccttccctgttggagcattcacttctctgagtgccgtttttttccaagtgtcaagtggcagtaatcatttctcctcctaaggacagtgtggaggctaaaaacaagttatgtgaaggtttcagctcaggctctcagtcctaaaaaataagacttattatgagagggtatagacgaggtggtctagaacacaggttttgaggtaagagttgggttaaaatcctggctctgctgtccaccagctctgccacctagggcacgttatttagcctctctgagcctacctcatggggtttgtaaagattaagcagtgggccaggcacggtggctcatgcctgtaatcccagcactttgggaggccaaggcgggtggatcacgaggtcaggagttcgcaattagcctgaccaacatggtgaaaccccatctctactaaaaatacaaaaattagccaggcatggtggtacacgcctgaagtcccagctactcaggaggctgaggcaggagaattgcttgaaccc

SEQ ID NO: 9099 - DNA, 429 bp, Homo sapiens
gactcacagggggatctgttgcaagctgaagtttgagaccaggatgctagaccctgaactacttgaggacagaaatcctacttctccctcacctgagtacctagcccagtacctggtcttcaggagatatcaaaagctatttgttgggcggatggtgggtaaatgaatgagtgggtgagaggccattcatctctgtacagctctgttgaatgtatcctcttttgtcttgcacaccattcctgcttccgctgggatgtgcgtgcttcccaggccagtgccaggagctacagtcatgccaggtggcagcagatgagacctactttggaaacctgtgtccgactcagggcagttacctgtgggtgcagtaccagtgccgggaaggtgagtccccaacttgcttgagcatagaaatgtccctctgattttatg

SEQ ID NO: 9100 - DNA, 615 bp, Homo sapiens
ttcatttgcatttccctgatgattagtgatgctgaggttttttttcatagacctgttggccatgcatactttaattcttataaatgaaaaccacatatacaatgtaacccagtgagttaggcagggatatgataaccatgagatcaactaaccctgggaagtggcaggacccgacctatgcaaatgccatgtcttcctgaaaccctgttccagaattgctttcatgtgactctctttctactctttcacactatctctttgtttacatacttcccccaacttacatattcccaaccacaccattttaatctcagtgcatgactgatttacagctttgccactctatgtgagcactgaccccaaaagggacttccaatctgtttagttactagattataatacagaagagaaaaataaacgtaacattgaattcctatacccatattagctttttacaaatcagatcaaccatggcagtgaagactcaccattcatcttttcgttcattaatattataaggaaatctattcctgtgggcagacattaaacatgagagaaattaacacagttgcactaatgcaaacacaatgtcaataatttataatctgggaaaag

SEQ ID NO: 9101 - DNA, 379 bp, Homo sapiens
gtgtccccaccagactgaaacactgtacccagaacgagaaaaagctcatattttctttaacaattagcaattctgcaaataaaggggtaggaaacttaaggggagatgtagtctgaggatacagaaagccaacaagcaaaaatttcttctagttaactctgaaagctgcccaaaatggcataggttaaagtggaaggtagtgggctccctgtcatggggatatattcaagtaggggttggacagccacctcaaagggctgcttttaaaagaagagctggttagtcaaaagttccttcaggctggtcgcggtggctcacacctgtaatcccagcactttgggaggccaaggcgagtggatcacctgaagtcacgagtttg

SEQ ID NO: 9102 - DNA, 561 bp, Homo sapiens
gaggttctgataataggtactaaaaataaatctgggctttattaattgaaacctttgtaccccctcccatcttcatttcccttcccttcgccatggctgacaggcataactttccattctttctgaatgcttatcccaaagtagccatgagtgactttcctgatactgcttcgggggtgggataagttcagaagaactaagaagataaacaacaaacaaagcaaaacattacaaaataagcaaagaaacagtacaacccaccaaaaattgtatcaaagtctagattattaagacattgtacttgctgttttgaaaatactcttctgaactttgagtacagttcaaagtcaatgacattattttaaaatcttctatgtgagagctgctacaagaacaattgtatagtgattaaaattaaaaaaaaatttttagttgggtgtggtggcacacacctgtagtcccagttactggggaggctgaagtaggagggtcaactgagcccgggaggtcaaggctacagtgagccgtgattgcgccactgcactccagcctgggtggcag

SEQ ID NO: 9103 - DNA, 361 bp, Homo sapiens
ggtggagattgcagtgagccgagattgtgccacttcactccagcctaggtgacacagcaagactccatctcaaaaaaaaaaaaaaaaatttttggtttttttttacccccttacccccccccaaaataaaaggccttttaaaccccggtaaaccggctttttacctttaaaaagaattttgaaaaaaaggttttttttttccccccaaacgggattttgtaaaaccaaaatttttgttcattgaaccctaaaactcgggggttaaagaaaccttcttgcttaaccctccaaataaaaaagggccccccccaacccggggaatttttgttttattcccaaaaaaaaggggggttttgttttt

SEQ ID NO: 9104 - DNA, 94 bp, Homo sapiens
atgtcaatgtgtctgttgtcatggcggaggtggacggcacctgctactgagccgcccgcctgtccccacccctgaataaactccatgctcccac

SEQ ID NO: 9105 - DNA, 488 bp, Homo sapiens
gaatattaattgtcagaaaacaaaaatgaaatacagaaatagcttgattatttacagcttggctcagcatttgccacatttgcacatggtctgaccagttaacagactatgattggcttaagcttagctactatgattggctaagactaagccacaagttacaaaatatactcttaatttagattgcagtctgtttacacactatgttaggttaaggatgtaagtacagaggcagctttaacaatctaatttaacaatattatctaatttaacaatattatccagtggcatagaaagaataatgtgactttaggtttttactaaataaataaatgtagaaatatcctaatagaggacacagtggccaaagtatactccaaaaacatacaagtcataataagatttaagtgagattttaatgacaggtttttaaaaaattgtcttaagaataaatcattcaaaccatggtaaaatagttgacaatcggg

SEQ ID NO: 9106 - DNA, 310 bp, Homo sapiens
acatctggaagaaataaatttcctaggatcaaagggctccgtgtgcagcccagagggtcctcagggtgctcctcagagcaaacaaacagttttcttgatgagtcactgcaattttttttttttttgccaaaagcccacatgtattgcaagatctcaaggaaaagaggtggagtaaggagaaagaaaaaaaaatttaattagggcaccagaagtcatttttaaaaattttacccccaaaaaaaaaaaaaaaaaaaaaaaaaaaggggggccctttttttccgaaaccccaaccggaaaaaaacccttgggg

SEQ ID NO: 9107 - DNA, 578 bp, Homo sapiens
ttgatttcaaaattccaaatatttttgaggacccaccgtaagtctttttcatgggtttttataggaagtacatgtccctggtttaaagatactctggtgaggttctcttgccctgaggaggggctctaagaatgaggcccttgcataggcagtctgggagaagggcaaaagcagaagggattctgtgagtctggaaagttcctcagcaccttcttaactctgagcgtaagtgctagggtgtactggggcatgcctgagctgccagaaggaatatagacacatctacagtcttaattttgacaaacaaaactggtcagtgaactggaagagttaagtattagttaaggggaatctgaaacttccttcccaggtcaaaaatatcttcaccacccaccatatcttttatgcaacacatatgtcctgagtaggcactctgggccaggagggatttctacagtgtactagacacaggcattactttcaatgaccctggtgatcctcagggcaaagaaaactataattaccagaaaggttaatatgttgaactttatatattggaaaaatatggcaccaaatct

SEQ ID NO: 9108 - DNA, 617 bp, Homo sapiens
aattcggcacgaggtggcccaaggggcccacaataaataacacagtcactcctattggtacagcaatgccaagatttagaagttatttcataggagctgggacaaaggtcaaacctctctttgggcaagaccgtattctttattgcatagctttgaaaagagattttgtattacccaaacatttattttaaaaaggcacccccatatatccatcactcgaactgtacatttctaaatgtacattgacctttggtatattagtctagcaatccagattttgcctcttgttaagcgtatcagggtcctggcaggaagtagacgacacactgaaggataactgtcaaaagtttaatgaagagactatttacaaaggtgtgggcaaagttaaggggaacaacaagtaagagatggtgtagcatcttagacctagcaacagcagaaaataattgccactcctaactctgaagagataaggagagggaatacttagcagaacacagcaagattgattagtaaagcacagagctcctgacgaggagatgtgaccttcaggagaggaatactacccccaagctatggcccagcagggaaagagcataggtaatacattctctgac

SEQ ID NO: 9109 - DNA, 406 bp, Homo sapiens
ggcacgaggcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatcacatatagaagtatggcaccatgaatgagaaaggaaaaaactgtcagaacaagaccctcaagactttactggaattaacaagcaatatgtaaagtaaatagaaataagctattcataataagaataatgtataagagactactaaaaataactgggcagatttgaaaataatctaagttctgggaatgaaaataataactgaaaaacagctgaaagagagaattaatgaactaaaagaa

SEQ ID NO: 9110 - DNA, 479 bp, Homo sapiens
tcattgtgtaataaaatggcagtttccaaagatggatgtctttagtttttaaatgacatgttgatttttttcatgatatctgcaaatatttttgtcttttttgacctcagaacaaatgtaaagcattgattggagcacacacaaaagttaggaaatatgctgcttggcaactgagtaaaagtaaatatatagtctcttaaacttccaaaaaagtatacaatagtacaggatgggttctattcacaagctttctgtctgtaacgtaaaagatatcactatctaaaaataaaatcagaatgatgaatttcagtgacaacaataaaagttttgggaccgtgagagttgttcatctaattgagggcactgccttttcttgtcctcaggtataggatattgctccattttaagccattgagggagaagggctttgtatttaaattgcaagctaataaatagtctttttctcattaacacacatg

SEQ ID NO: 9111 - DNA, 224 bp, Homo sapiens
ggccagtgtgggacagggttgtgtaggtgtgcatttcaaacacatttattattcagaagtggtgcagataacgcttagattacaccgaagaatttagggagggtgggggatgaaggtctgttagtaaccagaaacacattagttgggcatcagtaaggggcaacataaaggaatggttcccctcaaaaacgaacaaaccaaattttatacaaaaaaatgaaatg

SEQ ID NO: 9112 - DNA, 493 bp, Homo sapiens
ggcacgagggggaaaataacccagttttgatcttttttagtctgggtgcttactggatgtcaaggtagaaagtgtccaacaaggtgctttaactataggttgagttctcaaaaaggttaagagggtagagttatagtgacatcttcagcatatatagtagttgaggccagtggaaaatttcccattgagagctctgagaggaaagtattttagaagccaagggaaaaaggagtattgagaaagcgttagatatcacagaaaaattagattggtgatttctaagacaaggatataaccgttaggatgtcattgacctttgtgggagtaataatggggacagaagtcaggttttgctataagttgagggtgtccaatcttttggcttccctggtctactttggaagaattgtcttgggccacctataaaatacactaacactaaaggtagcggatgcgctaaaaaaaacgaatcacaaaaaaaatctcataatgt

SEQ ID NO: 9113 - DNA, 140 bp, Homo sapiens
aggtattgtgttatagcagcataaatggactaagacaatgccaaaggtggcacttgccatagatctgctgtgatgatatcaactctttgctttccaggagttaaagctttggattctgatgggttgattttcttttgtgt

SEQ ID NO: 9114 - DNA, 300 bp, Homo sapiens
cctagttaaatcacaacaagttagtaatccataaatgatgtgtcctgtttctctttagtagaaattatatttttggctaccagttaagaaacttgtactcctttgtcccttatgttactataaactcaagatgatgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaa

SEQ ID NO: 9115 - DNA, 306 bp, Homo sapiens
gtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagtt

SEQ ID NO: 9116 - DNA, 96 bp, Homo sapiens
ctcctcttgtcattcctaggacatagacggttagggaaactctcatctttccttcaccacctcatgagtctaaaaacaatgataaacccagggaag

SEQ ID NO: 9117 - DNA, 491 bp, Homo sapiens
  misc_feature 271: n = A,T,C or G
gaattcggcacgaggttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctntaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggct

SEQ ID NO: 9118 - DNA, 553 bp, Homo sapiens
ggcacgagcttgaagtagaattttttttcattccttacacttctcagtgagtggtaactgtagtttttgctatcatttttcattttcgtttttgcagttgaacatacttttttcactcagagagttggagggacttgcccaagactgcccaatggcaatgagatttcaacctcaaatcaatgttctttttaatgcaagatgataaagagtgggatttatcctaatttaggatagaataaagccaaatactttaggataggttctttggtgtccatgggtgcaatctaatgcccatgatgcaagtggcagagtagagaattagtgcacagcaataattaaagtgacatattgccaaaggaagcggttatagcccattatataataccttttaaaggacagacgcatactcaggtttattttacctgctgagcttctgccttagaagttttcagaattgtgattacattgaataggaaaaaagtctgaactatcagaagcagtgccgcaactttgacaaacaactgattatataataatctgcctctagcatgag

SEQ ID NO: 9119 - DNA, 395 bp, Homo sapiens
gaattcggcacgaggcttgatcgtctgggcctgtgtttcaactgggataggattctcaatccttcttgttcaaactctgaagtccagaaagctctgaaaactgaaagtttttccataatttatttcactgtaaaacctgaattgaactgatatttatctcactaaaaatgagtattcatatattgtactgtaagaatcgtaaaattaccaagtaatatcccagacctagttagataaatgcactattggcttttaattccaaaaaaatcttaattctgaggcacatttggctgacagcatttcagatcagggattttgaacctctaattcaatgatgtagataaatatcaccacttctactaccattgtctattactgaacacttaccatgggcc

SEQ ID NO: 9120 - DNA, 449 bp, Homo sapiens
ggcacgagggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacagattcccagcagtaagtagatgaggttgtgttttttataaaagataacgaggcattccttccagaaatgtggagcctttgtagatttcagtgcataaaaccaagcc

SEQ ID NO: 9121 - DNA, 480 bp, Homo sapiens
atgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgacaggcttttggtgcaggcaaccgttaacctcctgcttcctttgttacctctggattactttgcagtaaattgcaggtcttttaagagatttaagcttcagttttctcaaaacaaaacaattatcctgtcttatctgaagatgcaaggttgtgggcaaaagacgctggttataataatgccctcatattgagtggtctgtaaacggctgcacacttcaggcactgtagttgctgaaaatgctttgttaaatgtgaccttgactggctttacaggggtgtagaatgtaatctacaca

SEQ ID NO: 9122 - DNA, 466 bp, Homo sapiens
  misc_feature 372: n = A,T,C or G
ggctcgaggagagagagagagagagagagagagagagagagagagagagagagagagagagagagagagagagagagagagagagagagagagagagagagagagagagagagagagagagagagagagagagagagagagagagagagagagagagcgcgcgggcgcctctctctctttttctgtctctctcgcgcgagatatttgtgttctctctctctcaccctcttgtgggcgcgcgcccccccccccctctctctctatttctctctgtgtggcggcacacagagtatacactctctccccatcatccttctctcttacagaggggcttctttttctttactcacactctctcacgggaaatttttnttttttgtttttttgcccccggggctccctatttttatattatacccccccccctcctttgtgttttttttttccccgcccgaaattttttttt

SEQ ID NO: 9123 - DNA, 522 bp, Homo sapiens
tcgtttgtgcctgagcacccacaatttcaggatttaaactgtgtggcacctcagctttcctctggatgtaaccactccttggtgaaaaagggaactcctaaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatatatttataaaaccagaatatcaaaaatgggtgatgtataatgtctctttagttttttggtatttggcctcttttaaagcctgtcggatgtatgggagaaaacaatgaacgtgctttgatttcctatcagtcactcttaagaacatacatattg

SEQ ID NO: 9124 - DNA, 300 bp, Homo sapiens
gctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatggggg

SEQ ID NO: 9125 - DNA, 354 bp, Homo sapiens
aatgagaacatgatttttaaaaaaatattcactcattgttttattttggtcaaaatgctacaaatccttagaaaagtaaattctaaagtatagagtttatcttttttaactattaaaacctgatgaatattacaggatatgtcctaaaagtataacattgattaattagccttcagtgtaagcaacaggtcatctccgttccaaataggacctcagtaaacctggatgaactagagaattgaagataaccttaaagctaatgctctttaggctgggcatggtggctcacacctcccaaagtgctgggattacaggcatgaaccaccgtgcccagtctttttttttttttttaaa

SEQ ID NO: 9126 - DNA, 462 bp, Homo sapiens
atagaataaaaatgtaaaaaccaacaaattaatagactgtgtgtaaaagacataagaacattatctagtatgattgtgggcattaaagccaaacacatttcatcggcccagaatggccatttcacctctagcttctgagtaggagagtcgtgaatgctttgtccattgtgcatgtaaacaaaagtcatataatctcacttttaacagggtcagaagaacctatttcttcttaactattacaaatgcattttcctgcatcgattggaaatccaggacatcactaaagatttttccattttggcatgtctttaggaggaagaaatcgtggactggtggagtaaattttatgcttcctcaggggaacatgaaaaatgcggacagtatattcagaaaggctattccaagctcaaggtacctggatctgtgctgctatgggtggagaatcgacatcctttgaaactg

SEQ ID NO: 9127 - DNA, 466 bp, Homo sapiens
taaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgc

SEQ ID NO: 9128 - DNA, 276 bp, Homo sapiens
catgagccacggtgcctggttctcactgcccccgcccccctttttgttaacttcccattgtctgcaagaaaaaataagtttgatcattcagggttcctgatacatctgtctctgcttccctctccagcaaaatctttacttttcaacagaatttctgagttctggctatatgaaactattaaatactctcatattcagtacttttaatttcatatgaaatctgcctgggtttgttctgttggcagactttcagactgtgcatctttttttttttcc

SEQ ID NO: 9129 - DNA, 194 bp, Homo sapiens
ttttcctttggaaattcatactacaccctcgttcccagggaaggaaataaattgatcggtattgcacaagaacgagatctttgattcgtgtcaagattcgtttctaaccaaccagccagagctgaattgtttcgggggggggagcctggcctaacaaacgtatgagaggagaggtttggatttttttttttttg

SEQ ID NO: 9130 - DNA, 593 bp, Homo sapiens
ccaggcatttttctgtatatttatttctaatttctgtttctttcttatgaattgtctggttaagtcctttctcattatctcaaggtgttttagtatgagatttaagaatattagatatataagcccttgagctatcatattagttagaagtagttccccttttttggtcttttcatttttattactatatgtacaaaagtttaacatcctatggagtaccttgttcatggataggaagagtgaatattttaaggacagctctactctccaattggtttatagatgcaatgcaattctaatcaaagtctaaaaaggttctatgtaaaaccttacaggtttactctaaaatttatatggaagaggaaaaggctaaaagcatccaaaatacacttaacgaaaaagagcaaaacagggaggtttgtctcccagaaattaagatttattggaccgggcgcagtggctcagggccgggtgcggtggctcacacctgtaatcccagcactttgggaggccaaggtgggcggatcacctgaggtcaggagctcaagaccagcctgaccaacatggagaaactccatctctactaaaaacac

SEQ ID NO: 9131 - DNA, 656 bp, Homo sapiens
atgtttcattcaatggagtgggggttctgaattttccgtcttctttattcttggctcctgttatgttttgaagaatggtgaagaaaattataaaactaagtgacatgattataacaacacactttccaagctcagtgaagcactcaaagctactcaacaatatttttactgagctcttctcaactctctttctcaattcctatagcagctgttctaaaatgtctaccaattttctcaagatctccaggcactcttctcaatcccatcaattaatgtcctgattgataaaacagaggtctctacattcttcctctctatttccaaacttattaccacctacaccttctctacctgcacctttcttagaacagaaaggcttctccaatttgtaagcttaatgtccccatatcagttattgatttttcccgtatcccacacctcaaccctattctattactgataggtcaccccttcttcttagacagatctttcttccttttcacaaatgcataatgtgatatatgcatttgtgtaagaaactcacattcctcaaggtcctaaaaaacagtaaggtttttggataaataacattagtaagaatcttatgcaattctgtaataatcatgataacaccaccaacaatcacaatagatcat

SEQ ID NO: 9132 - DNA, 189 bp, Homo sapiens
tggcctttcaacagttttcatatttgaagaattagaaatgaagtccgttcaaattctccaaagaacctccagccactggtgggggacattcttaattcacattcctatcagttggtatctcctgtccctgaaaacactgatgaggcttgggaggagaatcccacctttccctgcagggggttaggctgg

SEQ ID NO: 9133 - DNA, 369 bp, Homo sapiens
tgagcaaggatggggctggggcgagagggagaacaggacggagctggcctccagctcctcatggtgcagatctgcgaggcacacatgacccgcagtgtccccaggtgacgcctcattaggaagtgggagatacatacaggttagcaaacctcggcctgcaggtcatgtccttttccgtgtgtcctgtgagtgaagaatggttttacattattttttattttagttttttgagacaaggtctcactccatcgcccaggctggggtgcagtggcatgatctcggctcactagagtctctgcctcctggtcccaagtgatcctcccgccttagcctccctagtagctggcactacaggtgcgtgccaccatg

SEQ ID NO: 9134 - DNA, 242 bp, Homo sapiens
acgacagaagggtacggctgcgagaagacgacagatgggtacggctgcgagaagacgacagaagggggcctacgtgttcttgcggtggcggagcggcggattagccttcgcggggcaaaatggagctcgaggccatgagcagatataccagcccagtgaacccagctgtcttcccccatctgaccgtggtgcttttggccattggcatgttcttcaccgcctgggtcttcgtttacgaggtc

SEQ ID NO: 9135 - DNA, 485 bp, Homo sapiens
tttggttgctgttctttcctagactcttcagaaaaaaatgaattaactagcaatgcttaaagaggtagtaaatacaagccaatccattttcattccagctgcatttcatgcttcagagtaatggctgttagccagaatcacttgtgaagctttatacacatatacattctgtgatcttattccctgtaaacccctattcagtagtcggtctgtgatgaaatcccaggcatcttcattcaggttaaaaaaaatatatatatgtctacatgaaattctggtattccctgttgaaaaccagtcttaagttagaggcattctgcagttgtacggaaagtaagggaaacaaagttaaaatggaaaaaattgaattaagaggcagaagtaatgaatttgatcatttgttcattgccactcattgtagacacttatttttgatctctgtaaacatcagcttatatctcaaagtatgaggtctgaatacttgc

SEQ ID NO: 9136 - DNA, 331 bp, Homo sapiens
ggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaa

SEQ ID NO: 9137 - DNA, 182 bp, Homo sapiens
gccctggcatatggaacctacccagtccattgctgcctgctacaagatatgaacagcaatggcacatattgtggttatgagtcactcattggactgcggattgaatgaactgtatccatccccatcatgatgtacagaaccaactctcttcactaatggagtctcactctgttgcccaagct

SEQ ID NO: 9138 - DNA, 344 bp, Homo sapiens
attacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgtgattctcctggatctttgtcaacctgactgtgcgattctgtatcttgggaaaagagtccttttatgacacattccatactgtggctgacatgatgtatttctg

SEQ ID NO: 9139 - DNA, 266 bp, Homo sapiens
cctactaggtcaagtgagtaccaaggacagcgtggcaggtgaccatacagacgcctgaataacaggaggcatgctgcattgaggcctacctttggaaaaagataccacgatgctttaacaaccgtggttaatagtgttcatgcctttgttaattgtactcatgaagtagtaataaaggttaatattctccattggcattatcaaatattaaagtactggccaggcgtggtagctcatgcctgtattgccagcaatttgggaggctg

SEQ ID NO: 9140 - DNA, 300 bp, Homo sapiens
aattccgttgctgtcgggcaggggaggggcttccaggattcacaggggcagatgggagccagcagtgggcagctgggagctgcgactcattcaaagagagggagttagtgcagggtaccgagatcaggaagaggagtggtgcagaggtgggaggtgatgagactcaagactacagagagaagaaagggccggcagcccagatcccagccccacccctcctgccctgcattcaggcagagcacagagggataaagagggaggtgggttgggggacaaggcagagatgcatatacctgggac

SEQ ID NO: 9141 - DNA, 88 bp, Homo sapiens
gcagtggacgtggatttggggatggctataatgggtatggaggaggacctggaggtggcaattttggaggtagccccggttatggagg

SEQ ID NO: 9142 - DNA, 285 bp, Homo sapiens
gcctgctacgcagccttaaaacctgaggctttaagttcctagtattgagaagccccagatttcatacttatttactctgttggtttcactttcctctccattttgtgtctcttgggataggctttgttttattttcaagctcagctatgtatataaaagaatgctgggctgggcgcagtggctcacgcctgtaatcccagcactttgggaggccgagttgggcggatcatgaggtcaggagttcgagactagcctggtcaacatggtgaaaacctgtctctacta

SEQ ID NO: 9143 - DNA, 318 bp, Homo sapiens
gacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaagtccttgtacaaggaggagcttgagcccaagtggcctacaccggaaaagctctgggattgggacatgtggatgcggatgcctgaacaacgccggggccgaaagtgcatcatccctgacgtttcccgatcctaccac

SEQ ID NO: 9144 - DNA, 457 bp, Homo sapiens
cccagagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctaaagcagctagcttgggctggattctcacacccaggctgccccttggattgttctacccaagcttttccctggggtctgggctcactccataaggtaaggtgccttttaccttatggtccttctt

SEQ ID NO: 9145 - DNA, 498 bp, Homo sapiens
gggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaag

SEQ ID NO: 9146 - DNA, 200 bp, Homo sapiens
ggagaacatcagtgaggtcctgaggaaagcagaatgaggccaaggaggtgttgaagtgtaatgcaggcacaacagagcctcaacctgttacacaggcagctctggagctctgatggccttcaagattgtcccaaattgaagtatggggattggacctttatatctcacatcaactaaaaatcattgatgaaactgctccc

SEQ ID NO: 9147 - DNA, 284 bp, Homo sapiens
ttatttccctcttttcaaagaataattattgctattgtttttgttagtatcccaaagaaaagttattatttttaatatacgcacctagatctctgtctctctctacacacacacacacacacacacacacacacatatttacatatagatataaatctggaatgtatctttttatacatacatttgaaatataaatcaatatctctgtatatatccatttatacttatatatatgcacatattggtattatttatagattaaaaaaaactactttgttaaatag

SEQ ID NO: 9148 - DNA, 281 bp, Homo sapiens
gtgctgggattgtaggcatgagccactgcgcctggcctcattattcatacttttctatctcccctctagattgtgtttctgtaacctattgtgcacacaataaccggcacgatgcatgcagaaaatgtttttgaatgacatgttggttgaataaaacttgttggatgaatggatagatgggtggatggatggggtaagtggacaatgatggaggatggatgggtggataaatggatggatggatggatttgatggctggatgcatggatgggtgagtgggg

SEQ ID NO: 9149 - DNA, 394 bp, Homo sapiens
gatggagaaatagacctcacctcttctgggtagagtagtggcaaagtcacattgtagaaaagcctgggaggtggaaaatttttttcatgattgtctttgtaaagtacaatctactacctacactttaacccaccaattcatcttttagaaatttatcctgtaagtggacttacaaatgtgaacaaaaataaatgaacaagggtatttgttactaaaatagtaatagcaaaagactggattaatctaaatgtccaataatagggttatttaacccaatttatttgtgcccatgcaatgcatagctatgtgcctgtctttttttttttttttttaaaaaagaattttttttttttcccccaggccgaattgggaattgaaggggccaattttgggt

SEQ ID NO: 9150 - DNA, 584 bp, Homo sapiens
gttctattgtgcagccaagtttgagaaccatgcaataggtccaactcattcaggaggggtgaaagtctaaatgccaaatgtagctgctccatgtctctggctctctgaggtcatttgtttattcatccaacaggccactcactaatgggtttccactgaggtcacagaaacacaatcttttgagtattagtgtaaaaactcccaactaaaccagaaaggacatcattaattcatttattcatttgataaacactgacttagaccttcatctgccccagtcactgtgatatgcctgggaatactgagttgattaatgattaattctagtgatcgagaagctccagaccaataagaggaatggatttcaacataataatatttactccctttacttttactgagtattctatgctagaaactgcacttagcaatttgtccacattatttatttttatcttcataaagccttctgatgtaagcagcattgtgcctgttttacagatgatgagcctaaggcttcaagagtaactgatcaggccaggcacggtggctcacgcctgtaatcccagcactttgggaggccg

SEQ ID NO: 9151 - DNA, 384 bp, Homo sapiens
ataactaacttcttttggtcttcccacatttaataacctctcgatcagagcctttctttttttatgtactcaaaaataatagaaatgccatttttaatatttaccaataacctatttaacttagtaaggaactgcttcccctgggggttagaaatttgtacacagccttctggatacaaataatctttatttaattaattaatttatttgttttttgagatggagtcttgctctgttgcccaggctggagtgcagtggctcgatctcgactcactgccatctcgccacctgggttcaggtaaaaaattctcctgtctcagcttcccgagtagctgggactacaggtgcatgccaccatgcccaactaatttttgtatttttagt

SEQ ID NO: 9152 - DNA, 230 bp, Homo sapiens
  misc_feature 73: n = A,T,C or G
ccacaatgtacgcatcgacggtggccttcattttatgttgcagaatgaatccgacgtataggaagtctttcangatattatccaggagaacttccccaacctagcaaggcaggccaacattcaaattcaggaaataaagagaacaccacaaagatactccttgagaagagcaactccaagacacacaattgtcagatttaccaaggttgaaatgaaggacaaaatgttaa

SEQ ID NO: 9153 - DNA, 343 bp, Homo sapiens
tactccacaaatagagatgtatctactcggatcgggggaactgtaggagagaattgtgaaagccacttcctacgcccaatacgaatgagttgtctttaaacatctgccaggcccaggcagctctccatgcaagtgcaagttcacaaagaagttttctactcctgtcctattccgccttcctttgatcctactctggaagagttagaaactggcaaacttggggtgcaagcataaaaattaggtgtctcatctccttccccactgtggacttctagcctacagaagttcctagctgaatgaaagacctagattttgtactatctcatgtttgggatttggattg

SEQ ID NO: 9154 - DNA, 630 bp, Homo sapiens
cttccccagtttaatataagaataagcagtctctgttctctaaaagccagaaggcttatgggggagaccaacgcactaatttagggcttcagcagaaatttctgtaaagtgaggtgtgcctacctttttccctaaatgagatgtcccctaccctacagattgatatttgatgatgcaaaacaattaaacaaaagactctctttgctgacctgtgaaatctgaagtttttacggtgaaaagtgctaatacattttcaaagttgacatagtatatttatcactttacacctaacggtctttctatgacgaattgacttaagcgctttgtactggagaatcagcacaaattaccttttttaaataaggggaaggctgaagtgacaagcttgtctcccctggagttaacaaatacagttctcttttagaatagggcgctttaaagttggagaagttctgagagcttgagggtcattcaaactgcaaggtaccctgttcaccgagtaattcaggttcagaaaagtcaagcagagatatatgcagtgatgtgtgcaaggcttcacagctgggaggttgtactacatccccacaatgataagcctttgctgccttcttgatcacttttgctacatct

SEQ ID NO: 9155 - DNA, 500 bp, Homo sapiens
gatgcccagaaaattggtaagctatgttaacaagccatattagatatcaagcattaatatggaaataaaccagcctgtttggtggtctcttcacatggacgcgcatgaaatttggtgccgtgactcggatcgggggacctcccttgggagatcaatcccctgtcctcctgctctttgctccgtgagaaacatccacctatggcctcaggtcctcagaccgaccagcccaagaaacatctcaccaatttcaaatccggcaggcatgtcaggcctctgagcccaagccaagccatcgcatcccctgtgacttgcacgtatacgcccagatggcctgaagtaactgaagaatcacaaaagaagtgaatatgccttgccccaccttaactgatgacattccaccacaaaagaagtgtaaatggccggtccttgccttaactgatgacattaccctgtgaaagtccttttcctggctcatcctggctcaaaaagctcccccactg

SEQ ID NO: 9156 - DNA, 608 bp, Homo sapiens
tctgtattgtggaatttctgaaagaaagtgtaaatggcaatgtgtggaactaaagggtaggcaggtagattaagcagtagattaagccagcagtaactgttctgtttgcttccgaaaagcatgctattttacccacaggccacagtttctccattcccagttgtccaggatattttctcctagagttgttccataattgcctatgtctctgatactaaggattcttaatatatgtcattcctccaacacacaggcatacacacatccatataaagttctattatattggtttttcagcaactatattaaaaatctacattgggccggacgcggtggctcacgcctgtaatcccagcactttgggaggccgaggcgggcggatcacgaggtcatgagatcgagaccatcctggctaacacggtgaaaccctgtctctactaaaaataataataaaaaaaaattagccgggtgcagtggtgggcgcctgcagtcccagctactcgggagactgaggcaggagaatggcgtgaacgtgggaggcggagcttgcagtgagccgagatagcgccactgcagtcaggcctgggcgaaagagcgagactctgtct

SEQ ID NO: 9157 - DNA, 356 bp, Homo sapiens
gggctgctttcttacctcatcattgataggcacacttgcactaagccttacaatacctctgtccataatagctgacatgtgtatgcaaaaggtaaggaaactatttattattcatagatattttatgtgtgttattaaaacaaacctaatgaaagttgagatgtgattaaattataaggatacaaacataaataatacttgatgctttctctcccaaggtgctttactacatagaaatatagaaagtaccgaagaaatagataatttccatttttagcttttccatttttttccctaaatttctaagttaagggcatcatcttcatatgtagttctccagtttttgagctgattct

SEQ ID NO: 9158 - DNA, 593 bp, Homo sapiens
ctacagaggcattaaatattgtagtcatattatagaaagtacaatgaattgttatggttttggtggacaaataattcttaattttcaatttaattgcaacagtaactataacatacaagaattaaaagtacagtggtatccttgagggatattttgcttaggactagaatatacaaccagagataaaaattgtgttagtaatataaaaattcaataatatgactgggctattactagatttggtgagaagtaggatatcaaaggcatttgctgggaggcatgagcagagaaaacgggacttaagagaattgttggccaggtggggtggctcacgcctgtactcccaacactttgggaagccaaagtgggcagatcatgaggtcaggagttcgagaccagcctggtcaatatggtgaaactccatctctactaaaaatacaaaaattagccagggctggtgtcatgcacctataatcccagctacttgggaggctgaggcagaagaatcacttgaatccgggaggcagagcttgcagtgagccgagatggcaccattgcactccagcctgggtgacagagtgagactccgtctc

SEQ ID NO: 9159 - DNA, 603 bp, Homo sapiens
tctggcctgaggacactatacacacagagcgcagtctatgtggaggccagaaagtggaggtcaaacacatatgtctacttattatttgaatttatttcttattcttcctatttttttaaattttgtagagatagggtctcgtcgcattgccaagggtggtctctaacctctgggctcaagcagtcctcccacctagacctcccaaagttctgggattgcaggagtgagcgactgcacctgaccacagttttctttgttagcagtcaaaaaagacgaagaaagaacgtgttcagctgtaattcctaggaaaaaatatgttcgggccgggcacagtggctcacgcctgcaatcccagcactttgggaggctgaggggggcagatcaccaggtcaggagatcaagaccatcctggctaacacggtgagatcccgtctttactaaaaatacaaaaaaaaattagccaggcgtggtggcgggcgcctgtagtcccggctactcgggaggctgaggcaggggaatcgcttgaacccgggagccggaggttgcagtgagccaagattgcgccactgcactccagcctgggcgacagagcgagactccgtc

SEQ ID NO: 9160 - DNA, 568 bp, Homo sapiens
tttctaagactatgttctctcgtcacgtcatgctacatgtgcccttaataccatggttcaacgttcttcagttctcttactgtcatcatttataattgccttttgagagatctcatccattcttaagatttgaatgtccacttctgcatggatggcatgcaacatctccagtactggcattttccatatattgcagtaccactttggaaatgcactgactctttaaaagccacataaatgttcagccattaaattcaaagttattatgtcttaataaaaatgatttcctcccatctcaaatcattattttctttcaactatcaatacaataacctgttacacaaatccgtacgttgtttatggtattttgaaaccatatttttatcttcattcttgtttgtaaaagataatctattattgaattctttcacacatcactctaaactcctttgcatttttctcttatccacttttactttcaagatttttatctaaccgctttatcccctacattgtgattcatacgcagcccctgggaagggaggagtgcctctgcccaaccacgatg

SEQ ID NO: 9161 - DNA, 564 bp, Homo sapiens
agtcaacaggtagaagctatagttttaagtgtagtgacactcctgctctgtaccttagtaaaaagaagtgtcccccttccagtaaccaaatttaaaaccacaaagcttatagttgcagggacaggaagcacaatttccccaaaacacatgaccatgaggtccactggttctgatatgtattgtactttctaaaggtaccagtccaatagtgtttgatacccgtgtcaatagtcacagtaatttgaagacgaaaacactggatcagtaaaagggatttcaaaggggcatcaatctcatctactacagtcttagttctattataattctagccccattttatccccttttatagtggaaatgaatattgcaattttcctgccccaaacttctcattgtgtattgagagtatagtggacagataaattgtctctttaattcacaggtcttcagaatgagagaagatatgccaaagactttttatctatacctgttcctgttatgatgatgaaatcctggactactagactgaatctgataccaaaattggaagagtttttgggtatc

SEQ ID NO: 9162 - DNA, 65 bp, Homo sapiens
ggcacgaggcacaggccacggagagagagaggccgggcctggatgaagccgtgggcgttggtgcc

SEQ ID NO: 9163 - DNA, 483 bp, Homo sapiens
ggcacgaggcacgcagcacccactcagcacctcttagaagatgcgtccgtagtatatagtatgatttttcgaaggggattttgctcatattaagggttgctttagggatgtccaggaagggtcaggtaaggaatctttcaatctgctttctaattggcttagttttcccactgtcttcgcaaaaggacaggaatttccaagttagtttgcagcttgtctttcatcaagcgaaatgctcatgctgttgggtagatggtaatagaaaccttttgctacctttatttatcaagagttgtggagccgaggaaccgtgtcttgggagttgtgcaggattgaaactcacaaaaaagcctgtttgaagaagttgttacctatatttattcaaggcagttcacaagccttatactaactttgcggggtctttcagttgagcttacatgactgcgcttggctttgtgccttggcagccaacatttgccatgc

SEQ ID NO: 9164 - DNA, 469 bp, Homo sapiens
ttatgacaacaccagagcttgagcatcttgagaaccaactttgcccaagaatattgattagtagtttctgccatggtcacaggaaaggagaatttagcattttgtgtctctgtgtgtcatacctgaataagagtctattggtgcaaaagagcatatccaatagtgatattcataaaataagtgacgcaaaatagtccatgcaggatgggcacagtatttcaataaaatacaggtagttaagtaaaggtaatttctagttgagtacataactgagacagaaaatatgtgcatagcaattttaaggtatgttaataaaaaagataaagaatttactaaaattaaattgcaagaattctgcaaccatattttctttgcaatttaattttctgtattttaatttcttgggatatatttatatttggcagtataggatggaattttcaaaaacaatattgaaaagggctgggca

SEQ ID NO: 9165 - DNA, 372 bp, Homo sapiens
acctggtgcctctgactgcgcctctgcctttgccgcctggctcctggtggttcaagttccagaaaggtccgagggctgtagggtccttagagaacctagaggctcctcctaggaacctttaaaaatgataccctgccctgcgttggagcctgtgaatttctttgcatgtgaggggccagctgtcaggtggtcggctgagccagggcagacccaggagcccagcacgccatcgcggaggcctttctgatggcacagtgctagccgttcctcctgcttctccgcccacttggccatgtctgggaaaaggctccccccaactcccttgctctccctggagcaccacgggcaggactctgaccgggatgggcaggt

SEQ ID NO: 9166 - DNA, 337 bp, Homo sapiens
ttctataactatgttaatgtgacctgtaaaacagttcacttctcaacaagtcagcttcctcatatttaaaatgagaagttgtcttgagtttctaaagatgtttaggctgcattgtcttgggcctgctcaggattttgacctctgagataaaagctggatttaaaaagccaatccaagccaaacacctggcattattagcattgttattccatcagatctgtttgtttgataaagaagctgggggtggaattggtggtgccttaaataccctagcttggtgcagaggtaagatactctgtctgggccacggtggctcatgcctgtaatcccagcactt

SEQ ID NO: 9167 - DNA, 422 bp, Homo sapiens
ctgctgcgcaccctggagatggggtgtgaccctgggctcccgttaatgttgttgtggctccagatgcctcagaaataacttccagagtcaacaccatctgcggaagtgccgtgagacggtgcatgggctggagacagagacagccggcgccgaacatacctggggctgcccgtgcaaactggggcaagcccttcagcctccatgtggctgctttactatggagaacagaaatgactagaacctgacttgtggggttatggcgagggtggcatgagatgagctttgtaacaatgtgttgtttatgggcagcaaaaccctgactcattgtctgggttactaatatccaagagttcatcatcagcgataattattgtcaatagtcgtaactgcaaaagtctcttttaaagctaaaatggatgccg

SEQ ID NO: 9168 - DNA, 523 bp, Homo sapiens
caagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaagatggtctcaatctcttgacctcgtgatacgcccgccttggcctcccaaagtgctgggattacaggtgtg

SEQ ID NO: 9169 - DNA, 613 bp, Homo sapiens
  misc_feature 543: n = A,T,C or G
tgtatttttagtagagatggggtttcaccatgttggccaggctggtctcgatctcttgaccttgtgatccacccgcctcagccccccaaagtgctgggattacaggcatgagccacctcgcccgtcctgacagagcttttaaggatgcatggagttctggggagttgagtctgttttcttgtctcatcagaaacacatcagaaaacacctttgaagtttaaggtgccagcaggtgtccctaagcattctaagtctacacgctgtgccccgtgcaatatcacttaagttaaactaataccttttctgctggtcttcacacagctactaatatgttctgatatataacatttctctgagaggggaatcaagaatgcaattttggctgggtgcagtggcttacaactgtaagcccagcactttgggaggctgaggcgggcagatcacctgaggtcaggagttcaagacatgcatggccaacatggcaaaaccctgtcttctactaaaaagacaaaaattggtcaggcacggtggcaggcgcctganatcccagctacttgggaggctgaggcaggggaatcgcttgaacctgggggcggatgttgcagtgagctga

SEQ ID NO: 9170 - DNA, 505 bp, Homo sapiens
gtattaaaagaaattgtattgtccagtgaagttttaagaaacagaaaccataaggtgattattatttttcaagccccaaaggagaattcattagatgacatacttttaaagttcatggatcagggtcgggtgcggtggctcatgcctgtaatcccagcactttgggaggccaaggtgggcagatcacctgaggtcaggagttggagaccagcctggccaacatggtgaagctccatctctactaaaagtacaaaaaattagccaggcgtggtggcacatgcctgaaatcccggctatccgggaggccgaggttgcagtgagctgagatcgcgccactgtaccctagctcgggtgacagagtgagactctgtcttagaaaataaagtccatgggctggtcgcagtggctcacgcctgtaatcccagcactttgggaggccaaggcaggtggatcatgaggtccggaaatcgagaccaccctggctaacaggtgaaaccccaaaatt

SEQ ID NO: 9171 - DNA, 277 bp, Homo sapiens
  misc_feature 223, 277: n = A,T,C or G
acgacagaaggatacggctgcgagaagacgacagaaggggctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaagacagcgcctggatctttctggggaggcttccttatgnactgactgaaggggacatcatctgggtgttctcacaatatggggagaatggtan

SEQ ID NO: 9172 - DNA, 579 bp, Homo sapiens
atggtaatgctataaaatctctgtttaaaataaagttattaagaaaaatgtgagctgggttaaagaaaagtgttatagtgagacaggttgaagatggttttggccaaagccatgagagtctgggaaactatggcctcaggtctgggaagcattcctctcctgcaagtctcagctttgcccatcaacatgctgggtggccttgggccagggactttccctctctcagtttcatccagtgttaggtgagaggatggaaccagagcagaggtggctgagtccagagagtgcagaggagaggccctgggcaaaggggtgaggaggaaggctctggaaagctggggatggctgggtgcggtggctcacacctgtaaccccagcactttgggaggctgaggtgggtggatcacttgaggtcagaagttcaagaccagcctggccaacatggcaaaaccctatctctactaaaaaaaatacaaaaattagccgagcgtagtggcgtgtgcctgtagtcccagctactcgggaggctgaggcaggagaatcacttgaacctgggaggtggaggttcagtgagttgag

SEQ ID NO: 9173 - DNA, 91 bp, Homo sapiens
gcaggagaatcgctggaacctggtaaacaggggttgcagtgagccgagagagtgccactgtactccagcctgggcaacagataaagacctt

SEQ ID NO: 9174 - DNA, 585 bp, Homo sapiens
ttcatgagatatcttgaggaaggtgctggacttcccacagtatgtggcatggagactggacgtgttttatatagttatccaaaaggttatgccagaaactgggagaagggaagacacctatgtcctccagataatttcaaaatggtttcaagaacactgatagagggaaacagtggggctgtggtacctgcgattagggatttgccatggaaaacagattccatattggagattttctcccaacattttattatgaaaatacatttacagaagagttgaaaaacctgtacagtgaaggctgggtgcattggcttacacctgtaatcccagtactttgggaggccaagggaagaggattgcttgaggccaggagttcaagaccaacctgggcaacatagtgagacaccaactgtacacaaaatttaaagaaaaaattaaccacgcctggtggtgtacgcctgtagtctcagctactctggaagctgagatgggaggctcccttgagcccagaagttcaaggttacagtgaactatgatcatgccactgcactcttgcctggaccacagagcacgaccgtgtgtctc

SEQ ID NO: 9175 - DNA, 408 bp, Homo sapiens
  misc_feature 312: n = A,T,C or G
tttcctactcatctgatccttttcctcattaaaccctcgcatctgcttcactctgcagtctgaagtttctaaggccagaactcatgacattattttattctacaccttgcttctcaacctgggtggactcatgcatcctttcattcattcaattctctggcactgtgtgaggtactgggaattcagtggggggaacaaggcaggtggagcccctactcccatggaagacagacagtgaatcaataacaaacacacagacaagatcattctagagagtaacagggattgtgaaggcaatagagagactacggnggaaaaaaagagagagactatgggagacagcactactttagcctgtgtggtcagggaaggcccctctgaggaggtgacatttgagctgagaactga

SEQ ID NO: 9176 - DNA, 497 bp, Homo sapiens
gagcatagactcttggtcagaagcccctgcttcctacagaatctctgctaatacccttgataattctattggcccaagatgcaaaaaagcccagaactactgcttaaactttcccaccaaagtacttgcgcctggctgggaagattgtgtcagccccactggaggtctggaaaagaggcccagattcaccaacctcaagcataaaatttctctgaagtctggccgggcggggtggctcatgcctgtaatcccagcactttgggaggctgaggcaagcagatcactttagtccaggagttcaagaccagacctggccaacatagcgaaacaccatctctactaaaaatacaaaaattagctgggcatggtggcgggcacctgtaatcccagctacgtgggaggctgaagcagggagaattgtttgaacccgggaggcagaggttgcagtgagccaagcttgcgccactgcactccagcctggttgacaaagcgagtct

SEQ ID NO: 9177 - DNA, 280 bp, Homo sapiens
tgtcccagtttttcctggactgaggggtttccttggacacaggactttcagtactaaaatgtaaaaatcccagacaaactgggacaagctggtcaaacctagttgagtttgaatttgatatttaacactttcaacatcttaatgacatttaagatgtgaaaatagaatgtatttttcatactcctcgtcactgggacactatatttcttcactgacaacttttaatggccaaggatcttatcactaatgaaaaagggaacaggctgggcgaggtagctca

SEQ ID NO: 9178 - DNA, 492 bp, Homo sapiens
ggactagctgggactacaggcatgcgccaccatgcctggctaatttttgtatttttagtaaagacggggttccaccatgttggccaggctggtctcaaactcctgacctcaagtgatcctcccgccttggcctcccaaagtgctgggattacaggcatgaggcaccatgcccagccctgttattggatttttctgtccaaattttgaatctagacactgacacagggagtaggccttccagtttctagttggtacaaagaagagttgagaaatttgagagaggcaataatttcagccccattcttaacacagttggcttagttggtaactgttgaagattattcacctactttttcctcaattcttgctttagaagagccatcaaggaacagctattaccagcagaactgctggaaggaatccagtagatctggccccttgggagagtgggggaagagcaagagtagcctcagggaaaggggtcagggagag

SEQ ID NO: 9179 - DNA, 483 bp, Homo sapiens
gagtggaagaaaaggcaaatctgtattggatagacatcagtactatctgccacacgtataactgtgctgtgttaaaactgctaatattttttccaaagccagtttaaagaaatgcagttttttagatgttttgaacaattgatttaataatatgcaacgatagatggaattttatatttaccataaaaatcttggaattctggccgggtgtggtggctcatgcctggaatcccagcactttggtaggccgaggcaggtggatcacctgaggtcaggagttcgagaccagcctggccaacacggtgaaaccccatctctaataaaaatacacaaattagccgggcatggtggtgagcacctgtaaccccagctactcgggaggctgaggcaggagaattacttgaacctgggaggcagaggttgcagtcagccaagatcatgacactgcactccagcctgggcaacagagcaagactccatctc

SEQ ID NO: 9180 - DNA, 225 bp, Homo sapiens
atggtttgtaaagactagggaaatcaaaattttataaatagggatctattgttttattaaatgagccctggggaacatttttaaagggttcaaaagtgagaggggattcctgtaggtaattagattcctgctgtctttggcctaaaacctaactaaatatacttaattaaatcacatatatgggccgggcgcggtggctcacacctgtaatcccagcactttggg

SEQ ID NO: 9181 - DNA, 62 bp, Homo sapiens
gttaataggacagaatcgctgctcctccatggcccctcttgttttatccctttctttggatc

SEQ ID NO: 9182 - DNA, 518 bp, Homo sapiens
aacctggtgagggcgtgttacatgctgcccagggccaggctgtgagtgctgtcttggacatctcgcccagaattgtgtttttgtttcaaggctaacacagaaaaccagtcttactttgggaaaggagaactggtttattattgattggatggaaagcaaatggccaggtctgtagtctccactgtaatttaaaaggctctatattatgataatcttttgacctgccaactttcttgttttcgttcaacagtgggagagtgggtcttgctcttctgtactactctgattgacaattctcaccaggttctactgaaaagatctagatcatagccatttgtctcataagccatttggctgaactgaaagatcaaatcatgtattcacaacattctgccttagtgttgatttctaaaagatcctagttcttaaaaaacacagcagaaatctaatgtgttctttagatgcagttggtgtagctggacattcagtatttgttggtacttggcaaaatgatggag

SEQ ID NO: 9183 - DNA, 114 bp, Homo sapiens
aaagtgcagggaaggtgcttggaactaaatgctcaaaaaaagtccatctggccaggtgcggtgtctcacaccagtaatcccagcactttgggagaccaaggcaggcggatcact

SEQ ID NO: 9184 - DNA, 582 bp, Homo sapiens
gtgaggtcaggagtttgagaccacccgggccaaactggtaaaaccccgtctctactaaaaatacaaaaattagacgggcatggtggcgggcacctgtattcccagctactcaataggctgaggcaggagaatcgcttgaacccaggaggcagaggttgtagtaagctgagatcgcaccactgcactccagcctgggcaacagagtgagactccgtctcaaaaagaaaagaaaaaaagaaaaaagaataatcctcaactttctccagtttaccagggataccgatacttttctctcaagcaattaaattgatggtagctcattccaactgaacgttaataacaagctgtttctcaaagcaacacacaaagaagttaattatataaatctatcacaatgggcagcatcagaacagtctgaggactataacaaatctacaatatctcatttacactataaacattccaatcaactcaattttccagttagaaaatctttttgttggccaggcgcagtggttcaagcctgtaatcccagcactttgggaggccgaggtgggtggatcacgaggtcaggagttcgag

SEQ ID NO: 9185 - DNA, 478 bp, Homo sapiens
gccctacattacgaatgcaaaagttttcttagaaatccaataactgtaatattggccagaactgtaatcaaatggtcaccctctaggtacaagggaggctggaagaatgaacatttttggctgggcacaccactaaacaaatccagggttttgatggaaaggaaggggtggggatggattgcaggtgacagctggtggtgcctaccacaagctccaataccaagatgggcactgaattcacagggatcttttaaatttagtttctggatttgagtgaaagcaaattgggttgcctcatccttcgaaggaaaagtggatccatagtattctactgtcagaaagggaaatagagtcaccttgaagacaagaggtgagagagtgctgcaggtctggagggccaagtggatagaagctcagcatgacctccctctctctgtctcccctttgttcactttcattagtcccgttcacttgggct

SEQ ID NO: 9186 - DNA, 622 bp, Homo sapiens
tcaagtgattagtgtggccaggcgtggtggctcatgcctctctaatcccagcactttgggaggctgaggtgggtggatcacctgaggccaggagtttgagaccagtctggctaacaaggcaaaaccctgtctgtacaaaaaatacaaaaattagccacgcgtggtggcacacacgtgtagtcccagtcactcgggaggctgaggcacgaaaatcccttgaacccaagaggcagaggttgcagtgagctgagattgtgctactgcactccagcctgggcaacagagtgagattctgtctccaaaaaaatttaaaaataaaaaaagattgagtgaagaaaaaaaaatttgcagattccatcagtcaaagccattttcatatatctcctttgaatttccatttctgtgtataagggttttaaaaaatagttatcatattaagtagacagttgtttaattttcacattacgcgagcatttccatttcattacctgattttcataaccatcactctctgatgactatgtaacattactctcagtgcatgtttctcttactaccccctattgttggatgtctaaattgcgtctgattttttctctgttccataaaattgaaataaata

SEQ ID NO: 9187 - DNA, 628 bp, Homo sapiens
tagtaggacttaaaaactagtgataaatgagaacaacaaaactatttaaatcctgctggaagcctgctctccaagataagtgtatccagtgtaagtcccctgagattctcctatcagggccgggtgatttacgagttgtatgatttatcaggctccatgtaccaggtgtcacctctgcattcagcttcactgatcaagaaaatgaattcgatcctggatctctgtccttccaatagcagcttgccaggagaagtcgttaatgtgatacattatcttgccggctgttaatatcatgtacccgtcttgtttcccttcttttagttcagctgagcatcaatttgtgccatgatatttacatgaatatcttcatttcatcagtaccattgtccatctgtttggctgagggctgaattacagagctgtggccaggaatggaggcattaggcagtctaaatgctaacttctcccaagagagaagggcagtcccgttttcagttttcctgcccctgcttgctgctgaaatgcagcctagcagacatagagcaggaattagaaaaatcatcctttaacagaaagttagaaaatgatgaggggccgggtgcagtggctcacgcctataatcccagca

SEQ ID NO: 9188 - DNA, 542 bp, Homo sapiens
aatttgtataaaatagtaagtggctggcaagtagaatcacaataagggattttacttttgttccaaatatatattccaggtcttgagtaaactaagtgataatactgattaataggagcatctattatacatgtgttatgtatgtgtattatccatagatatataatacatgtatatctggatttattatatgtgtatatatacagatacatacgtatgtatgcaaattaactttaatatctacaaaacacttaaaaatggatattagatcacaagtacagcctcaacaatgccaccaaaatatatatactgtgcaggtattattttattctccaactttccttgatttttgtttttccatcttattggtatccctactgtaataaaaaaaaaaggggggggagtttattttgtcaagtaattgcttaaaattcctttccatctcctcagatatttaaagaaaactcacagttttctttgtcccatcttttctccttggctacttccctacttttccctacaaatactatgtattattcaca

SEQ ID NO: 9189 - DNA, 164 bp, Homo sapiens
gaggtggaggctgcagtgagctgtgattgtgctgctgcactccagcatgggtgacagagtgagactctgtctcaaaaaagagtgtgtacacagccagagccatataaaatacaggcacagatcactctgcacctgtcatctaaaaagacacatctggctgggcg

SEQ ID NO: 9190 - DNA, 108 bp, Homo sapiens
gctggtgtgcagtggcatgatcacagctcactgcagtctcaacctcctgggctaaagtgagcctccctcttcagcctctcagtagctgggactacagacaggtaccac

SEQ ID NO: 9191 - DNA, 543 bp, Homo sapiens
gaagatactgtcagtctgacatacattatgcatctgtctatccagaattcctcacactgctgatttctgaagagcattccaacttcagtggatctttttcatctctgcgtcttgaccatctcaacctggcccttctgacaactccagtgagaagaaggcagaaattaagaacagaatatatattttttggtctcagtcatgctcaggatggcgcaagatgagaaacagcctggaatttcccatccttgacaatctttaccatatcctgcccttcttgggcattaagatagagttaagagataggaaaaaccaagaaaagcaaaagagtcaaccaataagaagagtataaaaggacaaatatgtcaatagtttatgttatggagtttgaattctcacttctccactttccagtaatatgacattgggcaattacataaattcaattagcttcagtctccttttccttaaaatgtggataacaaaagggttgactccatagggttgttatgactcaacacataacataaaaagtactcaaatatt

SEQ ID NO: 9192 - DNA, 433 bp, Homo sapiens
gagcaccgtcttttcccactcatctcacactatgctacttattctgaaattgcccaataaatacacctattaaggacacagatgattggtttgtctgaaagtccagatggaaaacagactcaacttttcttttttggtgtatatgtgtttgtgtgtgcgtgtgtgtgtgtgcgcgcgcgtgcgtgtgtatgtgtgtgtggtgggggagagaatgcacaaacactcgaggtggtttgtatatttgactggtgaatttcatagttgtttttctggggttacttagaatttgagagtccgtgagaagcattaggaagaacattactgagaaaaaaggaggggtgggaagcccctagacttctccccgagggtatccccgctgcagtcttctttagatgtttggattccccagtcctcttgttttgaggcgtgatat

SEQ ID NO: 9193 - DNA, 413 bp, Homo sapiens
agtgtccttcctaaaacataatctccatgagagcagggaccattctaggtacaggggatatgcaaggagcccctaagatatacctttgcatatcccctatacctagaatgatgtctggtacataataggtattcagcaaacattcattgtaatgaattagtgagttttactcaaaatgcaagaaagatgaattgaaactacaagatagtattttttttaacctaggaaattaggaaaactaaaagaaaaatggataacacactagatgaggaagattgtggtcaaataggtgttttcatgcattgctggtggcagtgtaaattgcttaaccatccatggagggcagtttggaaatattaatcaagattacaaatgctggcagggcatggtggctcacacctgtaatcccagca

SEQ ID NO: 9194 - DNA, 472 bp, Homo sapiens
actgttttttgtcttttttttagtcaaggtctcaccgtgtcacccaggctgaagcgtagtggtgtgattttaattaatttctgccttgaactgggctcaagtgatcttcccgcctcagcctcccgaggagctgggactacaggtgtgagccaccacgcccagctaatgtttttatttttacagagatgaggccttgctgtgttgcccaggctgggcagatcctcagcctcccaaagtgttgggattacaggcatgagccactgcgcctggccatctcatgtttaagtaagcttgggaagtgctacctgtttctgcaatactgattggagtgcttgctccatcacggtgctgagcacagagacagctctttaaaatttatcacacttaatcgtcaccacagccctgctaagtcacgggtcataccccccctttacagatggaaacaccaaggcagtccaaaggaaagtgctta

SEQ ID NO: 9195 - DNA, 320 bp, Homo sapiens
gcaacgtagtgggacccccgtctctaaaaaactaaaaaaattagcccagcatagtgatacatgcctgtagtcccagctactcaggaggctgaggtgggaggcttacttgagcccaagggtttgaggctgcagtgagctgtgattgctccatggcattccagcctaagcaacagaacaagattctgcctccaaaaaaaaataataaataaataaataaatatgattttgaaactttaatcatactttctattgattttgaaactgtaatcatactttctatatagttggctaagggaggctatagtgatgtttcgtccttc

SEQ ID NO: 9196 - DNA, 578 bp, Homo sapiens
  misc_feature 471: n = A,T,C or G
caacaaggctaggcactttcctaaatcagactcttacgaggaaaaacagctcacatttgttttctctcttcactgtggaaaatgttgcccacagcaccagggggatgatacccacttgccctgtgggcttatctggctcttcagggataaagaaagatgagaaaaggccatttagttaatgaggcctccacatccagttagaatttccttcggttccttcttccctcaatcctttcttctaaggctgtaagtggcctgagggtttgcatcactttgtgagtgtaaaatgttaggctcataaatgcttagtgagaacacaccttctctgtttcagacactgtgctctgccttgggcatacaaacatgaataagacactgtgtctgctttcctggaactttagactggcaagagaggtggattattttagcactacattattggtcttctgatagacacatggactctactgngggagcccaaaggagcagttcctgactcaagagagtagagtcagattttacctcctccaggaagataaaacctgagatcagcattgaagaatgtatcggtaggagtc

SEQ ID NO: 9197 - DNA, 532 bp, Homo sapiens
atgatacattcacacaatggaatactgtgcagtagtaaaaaagaatgaggaagttctttctgcatgtatataggatgatcttagagttacattgttatttaagaaaagcaagatgcttaacaggatgtactgatgctactatgtgaaaaaaagaggaaaacagcacatgcatattgtacatttgaatgtgtatatatacagacgtacaatatgtaggcatatgcatatacatatataaaatgtctctggaaggagcacagttgctttcaggagaggctggggtaaaaagggacttttcacagaatatcctttggtatctttgagttttaaatgacatgaatgtgtgtatatatattgatgagggaatctagagatccactgcacggagtaagaaatatgaagataagtgcagtgaagtgacttagaagggagagtcagagagaggaggcagtggtggttgaccctgttgtttggagtgataaacgctgtagaaagatcaagcatggggatgatgaaggaaaggtcatggtga

SEQ ID NO: 9198 - DNA, 492 bp, Homo sapiens
agaactgtttgtttatttatttattgagacagcctctctcttgcccaggctggagtgcagtggcaccatcttggctcactgcaacctctgcctcccagttcaagcaattttcctgcctcagcctcccgagtagctgggattatagacatacgccaccacgcctggctaatttttgtatttttagtagagacggggtttcaccctgttggccaggctgattttaaactcctggcctgaagagatctgaccatcttggcctcctaaagtgctgggattacaggcgtgagccaccgtgcctgcaataaggaggcttttaatctaaggtctgaatgacaagaatctaaaccatgaagagatcaggggagaaaaatgcaggaaaagaagacaaggacaaaggccttaaggtgagtgtgagccccaacaaaagtgggggagtgggggctggcacatgctgggttagagggtgaaggaattagatgaattttgaatact

SEQ ID NO: 9199 - DNA, 385 bp, Homo sapiens
tgcacacatatgtactatacatatatgcttataaaactcttcattttaggactatttcatttgcaactcactatagctgcaaattgaattaactaattgcaaacccagtttgctctagctgaagtatgtggaaaagattggattaactattatatctggaaagtcaaagggttttctggcctcaagcattgatgaatgaagggtatcaagctatatcaacaggatggatctctctcttttttctccactttcctctgtgctgtcttcattctcagaaggtactttccttgtggcagcaaagatgactcccatgatctctggatctgcatagttcttactatttgcaatctaagaacctatctctttgcgtccttattgctctttc

SEQ ID NO: 9200 - DNA, 465 bp, Homo sapiens
tagtaatttaaagaaaaaaaaagaaaacatgtttggagcaagagtacacatggtatgattagggcagcaatgactagtttgctccagtttggctggagcagagatgtggcacagtaggcttgtggcaggcaagaggatcacactgtgaagagccttgaatgcatagctaattcatttggtttcgtcatgtaaaaaaggggtccagtgaccacatctttgaggacaaaactcaaccttttgctgagaatacatttatacctgtcagatcacgtgactttgctttgatgccgagaaagatttcaccatggcaatggggagcccctgaaggtttttgagaatggtgccatgtgtgattataaaattagcctggagtgcgtagggctggagaggatggaaaccaggaggaggaaaagtcaggcccagtgtggtggctcacacctgtaatcccaacactttgggaggctg

SEQ ID NO: 9201 - DNA, 597 bp, Homo sapiens
gtcgtgttctgcactggggaagtttcaaatacagacattccgctttgtatcattgccaaactggaagtgattttgtgttttattcaagcatttcaaccacgctctgattagaaaacttttgatttaccacgttctgggaagaaatgaattatctagagcagagataaacctgtggtctaaaaatgggtctcagtggtgtccatggaaactgaaaaggtcacatttgtgtgagtgactgtatggtttgcagatgggagaggatttaaaactttctcagattctcaaatgggtgggtgaccccctcagtggttaagagctatttcctgcataggaaaagagttcactcactggctcttggaatttcatctcgcatgttgctcaggtagtttaatagaatttacgaaggggccacaaaggagtctaatgtcagtcactgaagagtaaaaattagaagctgatgagaaaaggccaggtgcagtggctcacgcctgtaatcccagcacttagggaggtcaaggtgggcaggtcacctgaggtcaggagtttaggaccagcctggccaatgtggcgaaaccccgtctctactaaaaatacaaa

SEQ ID NO: 9202 - DNA, 617 bp, Homo sapiens
gggtttcgtacgtagcagagcagctccctcgctgcgatctattgaaagtcagccctcgacacaagggtttgtcgaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacataca

SEQ ID NO: 9203 - DNA, 637 bp, Homo sapiens
agtccagcacacagaatccaagctctgcctgtgcattaggcttcaggacatgagggaatggcagtgaattagggctgcactatgccaggaacactcatttaccacaactggatttgtcagcagttccagtgaactttccttaggcattatagaattaactgtacttagagagaggttcttggttaacctcagtgttttcacattttaaattatttcctaagtttcaagtgaaactaaatatcatttgaaagacttttaaaggcagtctgcccaccccactccaactcaccccaatttccactaacaactacttcaaatgtaattgtcagaaagagcaccccactccactgcaccccaaatcagcctccgatagatattgcatctgaccctggggggcccttcccgctttcctcttgctatgctcactacactttatttccctcaatgaaaactccttccccaccctcctaatgtgtgacttcacattctatacatagaatttctttttttttccaaagtgaatatagttttatatattttttaactacataaaaataaaacacactcaatacaaaaagaaatggataaaacgcaaatgtgaaaacaaactcaccaatcaccaaccactcagaacttt

SEQ ID NO: 9204 - DNA, 595 bp, Homo sapiens
  misc_feature 89: n = A,T,C or G
agagaaaggttggggtaagtaatttcctcctaaaggggaaaaaagcctacaatttttgtataagtaactgaatccatatagaggcaggnctgacacttgaaaaaggtcacacagtgtgagtatccttagaaatagaatgtttcagtattgtggggacaaagttcagctcacttaagaacatttcctattacgaaccagttattttcaaaatgagactgctatgtagttatataaattactcaacaactgcagtagaactagatgtaatagctacaataatatttctagtataaattatctaagaatcatttttaacatatctcctttgttagtattcattatactcaaagcttgagggacaattgaataatcagcctctatattttcaaagttgttctacattgagagttgtcatcatttagttaagaaaactcgaaatttttgcacttatgttcaatgaggcaggttgaaaaagagtttccgctcttaacacgtcattattctcttttttcaaatgtaattacttagtcaattaacgtcactcttctgtaaaacatttaggtgtaagtgaaagccatttctttatcatcatact

SEQ ID NO: 9205 - DNA, 349 bp, Homo sapiens
ggcacgaggttaacttctctgagagagttccttgtaaggctacttataaatagtagtatatatatatatagtttatggcagggaagatctgggaagtaagcaaaaagagcctttagttaggcaacatagaacaaaatagaggtcacaggttccatgcactgaagaatggaattgaaatagagactccagggtcatagactcttggaaggaagactagagtacattcatgaccctcacccttaattacttcacaggtgagaaaaccaagagctacagaaaataagttattcctcagctccagggctacctgcgatctgtgtttgctctgacgaatggaatttatcctcac

SEQ ID NO: 9206 - DNA, 439 bp, Homo sapiens
ggcacgaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaac

SEQ ID NO: 9207 - DNA, 535 bp, Homo sapiens
ggcacgagatataaaagcgtttagaagaagaagcaaaagagacccgcacattccacccagggagggcatggagaaagaacagtgagtggaaggaaaacaggtctgtgctgtcctcaagcatagaggtctttctatggcacgcacccggagcagccaaaaggacactgtccacagccaggccagagtctagctgtcacacacatatgcaggtgtgttgcatacctcaagcatgcgttcacgagttgtaatacttaagtgaatttgtttttttacagcaacaacctatagttccatttaaaaagggatagttatttaattttaattaaaacatatagtagatgttttctcactttggattatgtatccatcttcaacagctttgttgaggtgttgtttacacaccctcaaattcactcgttttaagcatacaatctaataatttttagtaaattcagaattgcgcaaacatcacaatctagtaatagaaattctctttcactccaaaagaaacctgtgctctatttagcaactccct

SEQ ID NO: 9208 - DNA, 512 bp, Homo sapiens
ggcacgaggcctaaagtaactgaagatccatctttacgtatacgtgcaagtcacaagggatgcgatggcttggcttgggctcagaggcctgacactagttattataaaatgtactttcagcagtcttctgggacttgactaccttgtggattgtactagaaatgtcaggtatggtgactgctctgcccaccactctaaatgaaactgtccccccacagtctctgttgcccaggtgtcctatgtccctcgtcacagctgaatggaccaaggcagatgtgctatcaaggacagccaatcacaagtgagcagtaatctctgatatgctttggtgcaaaaagctgagttgagtcaacagttatttaaatttgtgtgcagtcacttccgtttgctggggaatggcgtggtgagggaagattgatataagttacctcatatctgggttacatggatatatatcctacagttgcttaaaatacatttcaggattctttggtttgcagcatgtgttttgg

SEQ ID NO: 9209 - DNA, 195 bp, Homo sapiens
ggcacgaggagctctctctggaaagctcgcactggaatggagaacacaagcaggaaatgtgaaaagtaacggttgaaagccttacttatgatgacacatagggaggcaggtgcatatcttacaattctagacacttggataccttgggaaaccatattgaaagttaccttgatttctttctttcttttttttttt

SEQ ID NO: 9210 - DNA, 227 bp, Homo sapiens
acagagcaggaagcccccccatgtccacctctacctcattttgtcaagtcttcaagagacctccaggcccagtcactgtgaattcattcctctgggtttaggcactcacctccccgccaccccagagaggtagcatattaaatcattaacagaatctaatataaaggggccctgtgattactgggaacaagttctcctgatttatatgcgattgaaccatattccct

SEQ ID NO: 9211 - DNA, 408 bp, Homo sapiens
tggaatgccccagagcacctggcctggctgaagcaggctgtgctcgggttccagcttccgcagatggaccttccacccctgggggccccctggctccccgggtgctccatggttgtccagtacgcctcccagatccccagctcacgccagacacagcctgtcctccagtcccaggtggagaacctgctccacagaacctactgtatgtggaagagcaagagtccctccccagtccatggggcaggcccctcggtcatggagatcccatgggatgatcttatcgccttgtgtatcaaccacaagctgagagactggacgcccccccggcttcctgttacatcagacgcgctgagtgaagatggtcagatatgtgtgcatttttttaaaaacgatttgaaaaaatatgat

SEQ ID NO: 9212 - DNA, 298 bp, Homo sapiens
aaagggcagcgggcagaaaccgggctggggctggcattagctttccctcctcccagtttctctccagcgcagcagggcacctctagcccagaaaaagaaaactgactttctcttatttctgttttctgctgctgctaatctcctcctgaagggttgtgtggcttcttgggactctggaaagaaactgcaggggacgaggacaaaagaaacagctactgtagtcactgcagctatgcaggctctgtgctagccctggaaaggcctggacgttcaagtctgctgtgccgggggtaggccc

SEQ ID NO: 9213 - DNA, 346 bp, Homo sapiens
gcctgggtggagcgtagacagctcagcaccccacggggggcgttggagccagccttggttttgttgggtaaggatgttagaagaggggcgaagacccatagccactggtgtgaagggtctgctcttgaccgaaggctgcctccctctgggtgcagaccaggcaggtggtcccagtcacggtgccctggggccactgggtctgtctgccctcaggctccactagacacacctgctgaggcagcacactagcaacggtgtctgtgaggggcagctgcacagccccctcttgagggtgctcctaagcgttggataagcccatgcgtttctgcttttggggagcagagcc

SEQ ID NO: 9214 - DNA, 117 bp, Homo sapiens
agacaaattgaaaagcttcagagaaaggctagaaataagattcttgggcgagaataagactttaagagattcacatatcctggaatctgaagactcacatgcctaggctgggcatgt

SEQ ID NO: 9215 - DNA, 305 bp, Homo sapiens
cgattcgtttgtaggcaatggaaagccaccagtggttttagttgagcagcaatgaaattaagcctgtgctttgcaaagattaatctagcagcaacagattggaagcaacaccaccattcctggtatcagatccaggtaaaatatattacagctctatactggagcaataacagtaatattagaaggagaaatagaacagaaaaatattgcacaggcagaatggggaggtcccacagatggagctgatcttggctcattgaagcatgggtggcattgatcatgtcaaacacaggatgaggaactgg

SEQ ID NO: 9216 - DNA, 489 bp, Homo sapiens
  misc_feature 418: n = A,T,C or G
attcggcacgaggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgacgaagatcattgggcgatacggtctcactgggaggccactgtaggaggatcaattgagcctagaagttcaagaccagcctgngcaaagtagggagaccccttctctacaaatagtaataaaatgaaccgggcatagtagcatgtgcctgcggt

SEQ ID NO: 9217 - DNA, 473 bp, Homo sapiens
tgcacgaggggacactggattctcattctactcaaactcccactaggactgttggcttgttcgcttctcaagtgtttgtatttttctgagttaatatttttgggtgtaatttacatgtaggaaaatgtacacatttttagtgtacagttcaccaagctttggcaagcatgtatagcctggtaacccacaagccaatggagacctagaacattcccgtgaccccagatgctgggttctgtgtgccttcccagggcttgtggctgggcacatcaggcatggcgggtaccatgcctgacagctctgaaccagttgggcgacctgggtctgggaggtgctgagggacccagcaccctgcaggcgtttccttttgtctcatgtagcagtgcagatgtttggaaagtcacacgtaaatcttgaaaaactggaaacaggccaggcgtggtggctcatgtctgtaatcccagcactttggg

SEQ ID NO: 9218 - DNA, 198 bp, Homo sapiens
ggcacgagatcacatctctcaagttttaaaatgggtttttttgttgttgttgatgggggggagagggtccaccagcttttaaatgttttcacatcgagtgttccaaaaataactggttagcctaagtcacttccaccctccaatgttgtgaatgcagtctctagcattcgctatttaatgtcttcttcctgcactatt

SEQ ID NO: 9219 - DNA, 569 bp, Homo sapiens
aaaagttaaaattttatttttctctcatgtaacattttggataatttgatgattccctaatgttgggacccagtcttttctgtcttaggctcacaactatccttgagcctgtgtcatgggggatgactctgaagctgcgtgcaccctgttcattcacattttcttggcctgaacttagtcactaggctattcctaactgcaagagaagctggaagatgtagtcttccttctgaccagccatgtgctcaaccacaaattgagtttcagttattggagggcagaaagaatagatatggggctgctttgtaggctgctgctcggggcagcctctgctgtgttatttgagatttataattttccttggcttcccagatgacagtggaaaaaggcatagtcaagacttcaagtgcggaaaatgttggcaactctgacatgcaagttcttttccatatagagctgagttatgctggagtattttggttacaaagacttcattttctcacctgtctgaattcctgtttggattttagttactcttgatttatcagcatggattaaaaattgaaaag

SEQ ID NO: 9220 - DNA, 496 bp, Homo sapiens
ggcacgaggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagca

SEQ ID NO: 9221 - DNA, 86 bp, Homo sapiens
aatgatggcataggtggatgaggacatcagatgggttaatctacaagtgaaatttgagggaacggtgttccaggcatagggaatag

SEQ ID NO: 9222 - DNA, 240 bp, Homo sapiens
ggcacgaggtctcgagtttgttgttttttgtaatccgttttagagtgaattaaactcagacatccctggattgtatgctgtctgtagaatgttgattttcaggcacggggatgtagctgtagaatgtggcttgttcattcttcctgataagaaattgatctcctgaatggattggccatttggtaatttcttagtgaaaggctgactcttgaatatggctgttataatataaattcttac

SEQ ID NO: 9223 - DNA, 492 bp, Homo sapiens
  misc_feature 428: n = A,T,C or G
catccctgacagttggataataggttccaggaagttcagtggtaaattattacaaagcaacatttatagctgattgaacttgaaaagccattttggtgttgaatggcaaatatgtggacttcagcattcctggagcctgatgcatcccgctggatggccctgttcctgtgtacatgatggcctggggactcagcagtgtgcagggtactctcctttagagggtgctttgaggaaagaagtttgctgccacttacagaagtccccttcccatacagtgatataacacaagtaccccatgtccagggagcatctttcctctgatggcttgaggacttatttattaaaaggacaggaatgtctggcaagaaacagaggagctcttaagtactgtaaatactcctagtcactctgcatcagggctgcaagtntaagcagattgctgtggtgtatacacatgattttagcatgataacacttctgtttaatgtcctt

SEQ ID NO: 9224 - DNA, 491 bp, Homo sapiens
aattcggcacgagcagggatccacttgccttaatttgcacagtgttcttataaatcaacagaaagtacacataacagaaaaatttaaaaggttagggatcatttatgaaaaaatgcaaatgccaacaaatgtgagaaaatgctcaatcttacttataatttaagaactacaattcagccaggcgcggtggctcatgcctgtaatcccagctacttgggaggctgaggcacgagaattgcttgaacccaagagggagaggttgcagtgagccaagatcatgccactgcactccagcctgggcgacagagcaagacttgtctcaaaaacaaacaaacataaaacaacaaaaaaattaccattaaaaatgagagagttttcattggcaaagttaaaaagaaaggtgaaagaaaaacctactcttcttgatttgtgtttgttcacttatggagaatttattttgtcataatgtctgaatcataattaaatatgtt

SEQ ID NO: 9225 - DNA, 419 bp, Homo sapiens
ggcacgagctctctctctctctctctctctctctctctctctctctctctctctctctctctctctctctgtgggtgtctctctatctatcggggggtgtgtcacacacacagagtgacacagacacagagagagagagagagagagagagagagagaagatctgcacgctcacagagagaaaaagggacagagagagcacactctctcgatagagcgaaaaaactctataacgcgagacaagagcgcgctcacgcgagagagcgcgcgcgcgagcgagagcgcgcgctctatgcaggccacaaagagagagagagatagagagatgggcacacatatatagagagagagacagatatagagagaggaacccccctcccatataaaaaagacaattatttccagagaaaaacgccaaat

SEQ ID NO: 9226 - DNA, 433 bp, Homo sapiens
ctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgtcatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttc

SEQ ID NO: 9227 - DNA, 334 bp, Homo sapiens
cagtttgaaaaaggacctggttgccaaagtaccatattacccatcaatgtcctctcctacccatttccctttttcacaccctctaaatctctataagcaaatgcggaaaatgcaaactaagctttgaacagaatcaaatgagtccctctgggacacttgcaggggacttatttcttccgaaggatgtgacagcagcttctcccaatagtggcagcgtttgtttcactgttagactggaggagcacaaggagcatacaacatgtggctctgtccacaccactgtgaagttgttggttctgagaaattactggggggagtgttaaaacaagattgg

SEQ ID NO: 9228 - DNA, 258 bp, Homo sapiens
ggcctctactgggaaccaccttctgtaggacagtcaccaggccagatccaaaaggcttgaggccctgtggtccccatccttgggagaagtcagctccagcaccatgaagggcatcctcgttgctggtatcactgcagtgcttgttgcagctgtaaaatctctgagctgcgtgcagtgtaattcatgggaaaaatcctgtgtcaacagcattgcctctgaatgtccctcacatgccaacaccagctgtatcagctcctc

SEQ ID NO: 9229 - DNA, 474 bp, Homo sapiens
ggcacgagacacttatgtgatcaccaaaggatttactagtatcttggtcattccaattgcacaatgttaactgtacaacacacagcgagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttggggcctaaacaactaaaattagtcaccgcataactagttgaaaatggcataggcataaaatgttaataaagaatggcagttatatttatgctcacttcctggagtaattgggtaatattcagaaaggcacatcgtggtagtttaagtgtaca

SEQ ID NO: 9230 - DNA, 411 bp, Homo sapiens
acccttaaggagttttgctaccacccatacggcaactgtctctcccgttagacctgggggcctcaaccttgacccccatatgtagttggtgggggaggcaaaggtggtctctgggcagggatacaggacaaaaaactgtgttttcacaaagtataaggagttttactttctagagtgccccccatcctacttttgactctgattaaaaattacctatgagactttgtgccttaaaaaataatttataggccgggcacagtggctcacgcctgtaatcccagcactttgggggaccaaggtgggtggatcataggtcatgagatcgagaccagcctgggcaatgtggtgaaaccccgtctctactaaaaatacaaaaattagccgggcgtggtggcacacgtctgtactccc

SEQ ID NO: 9231 - DNA, 122 bp, Homo sapiens
cacccaccacattaacaacataaaaccctcattcacacgagaaaacaccctcatgttcatacacctatcccccattctcctcctatccctcaaccccgacatcattaccgggttttcctcat

SEQ ID NO: 9232 - DNA, 410 bp, Homo sapiens
gttgagaagctgggaatggtggtggaacctaaaagacttccaactctgaggaaattgtggtagaaatggaagcagtataacctatgattgaacttaaccgatgtaggtgattgagattgtatttgcagagacaatgcttaaagaaataaaagaaacccagacataaaaactgaagctttaatggagatacataaatacataggaccttggaaaacaaatgaagtaatataactgcatataatttgtttacatatataaaacataggaaaatggaaatacagtgtattcttaagtgtacatttctctgtgtgaaatttattgtgtgcttttactttacataatctgtggaaagtatagaacgtgatccctacccttgagggataatgaggggtcactttatacttcaggga

SEQ ID NO: 9233 - DNA, 401 bp, Homo sapiens
ttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagatttttttttaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaa

SEQ ID NO: 9234 - DNA, 409 bp, Homo sapiens
accattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcaaactagtcctagtgttcagttttgttttgttttttttctgtgtctggaattctattaaaatgtgtcaggctgttttaatttttgttgtttaattttctttcacatgattatatgtgctccatggatttttttgtttgtttgtttttttgtttttgtttttgtttaagcggggtcttgctcttgtc

SEQ ID NO: 9235 - DNA, 254 bp, Homo sapiens
aatctgtacaaattattagtttatatagaatttaggcaacaaggcaaacaacaaaatgtaaaactggaaccacgccaattactggaaatcaagtatatatggaagagtcaagatcaaataaccaaaatccccataaattgtcaagagtttgagatcagcctggccaaaatagtgaaaccccatctctactaaaaacacaataattagccaggcatggtggcgcacgcctataatcccagctactcgggaggctg

SEQ ID NO: 9236 - DNA, 398 bp, Homo sapiens
acggacgtcaattagattaccatggcacaatacggccggaggtagggcacaggaagttaaaggtatttatcctggcaccagctgcgataatggttatgactaactcagtcagtaactttgaaagtctgtgataaccagcattgaagccaactgtgtttataacatgatggaaagtgtgtttgtgctaaaagcatatctgtgaggtgtgctaagaggtcatcctcaacagttttgggcttcttcctttaaaatatgtgattaacttgcttctggaattgaaaaagtaattctgcagtaagttattttgaagtgaggggtagttttgaagtgaggggtagtttaacactcattaggtgtttattactaataaagtataagctttgtttcaattcttggac

SEQ ID NO: 9237 - DNA, 506 bp, Homo sapiens
tgtccttgaatgacgtcctctttcctgttttatccccaagcccctgtatgtgagatctgccatccttcccctcaagagaatattctcccctaccctttgggtaggagtcctttcatgaggaaggtgggattttctgactaagctctacctaaggcattatcctttggcctaagggaactgaagtttccagcagaagccacagagctttaagataggaccttgggctgggcgcggtggctcacgcctgtaatcccagcactttgggaggccgagaggcaggtggatcacaaggtcaggagatagagaccatcctggctaacatggtgaaaccccatctctattaaaaaataaaaaaaattagccaggtgtggtggcaggtgcctgtagtcccagctactcgggaggctaaggcaggagaatggcgtgaacctgggaggcagagcttgcagtgagctgagatcgcaccactgcactctggtctgggcgacagagtgagactccgtctc

SEQ ID NO: 9238 - DNA, 577 bp, Homo sapiens
tagtattccatggtctactaaaattttaatgaatcattataaaagatgagtggtcctgatgtttcaccaactcttcaacctgtaaaaggaccgcaagagattcgctcaatttatactagctttgatatttttttaaaactgattattttttttagggtggttcacatctgtaatcccagaacagggaggccaagataggaggattgcttgagtccaggagctcaagatcatcctgggcaacataatgagactctgtctctacaaagaaaatcaaaaaagtggccaggcacgatggctcatgcctgtaatcccagcacttttggaggctgaggccggcagatcacgaggtcaggagttcgagaccagcctggccaatatggcataaccccgtctccactaaaaatacaaaaattagctgggcatggtggtgcatgcctgtagtcccacctactcaaggggctgaggcagaagaatcgcttgaatcgggaggtggaggttgaaatgagccgagatcacaccactgcattccagcctgggctacagaacaagacctgtctcaaaaaaaaaaaaaaaaaaa

SEQ ID NO: 9239 - DNA, 293 bp, Homo sapiens
cccaaagtgctgggattacaggcgtgagccaccgcgcccggcccaggtgaaatattattatcctccacctacaaactaagaaaaagaacctgaatgactgcccgggactccctgggtaggagagaggggagctaacaccagagcccaggtccccagctccccacccagggcttcactgcttggctccagtcaataaaatagcacaggtctaaagagtctaaaatctggaggtccccaccagaaagggatccttctttttttaaaaaggaaatatatccaaaggttagaatcag

SEQ ID NO: 9240 - DNA, 545 bp, Homo sapiens
agtacacactcctcagttatgtagattaaacaagaaaacaccagtagtttagccacttgtcaagtttcaacttaacttattatcatcatgatatgaataggaatgtataaaattctcagtttggggtagatgacgctatggttaaaactggaattttgtaatataaagcaagggggaaacaggtataagataacaagtggcaaatgacacaggattaaagaaaaatgagaaaagaaggggagaataaatgaaaatcaaattgaagagggaggaactagaaaaactgtaggacaaagtgtaaatgaaagaaaatggagccgggcgcggcggctcacgcctgtaatcccagcactttggaaggccaaggcgtgcggatcacgaggtcaggagctcgagaccatcctggctaacacagtgaaaccccgtctctactaaaaatacaaaaaaattagccgggcgtggtggtgggcgcctgtagtcccagctactcaggaggctgaggcaggagaatggcgcgaacccgggaggcggagcttgcagtgagc

SEQ ID NO: 9241 - DNA, 453 bp, Homo sapiens
gggagatggagagggaaagcatttggaagacagaaactgaatacacaaattgcaaatatttgaaatgaacaagaggtcatttcctacaaattataaatgttaaaatgataagggactattatgagcaaccatatgccaataaatttgtcaatttagctgtaatagaatatttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctc

SEQ ID NO: 9242 - DNA, 627 bp, Homo sapiens
ggattccaagacctgcagcctatatgaggtatgtaaaagctattttcataaggaaacaagcaggttgcacatataagcccaacacagattaggtgctcagttgaatcacattttgcagaaagttgtggtctgcatgtatgactatacctttagtctagctttacaaagacataaaacatgtcataatcataaactaaggataaaaggaccttaaaatctagtcatcttaaggctgggcatgctggctcacgcctgtaatcccagcattttgggaggccgaggcaggcagatcacttaaggtcaggggtttgagactagcctggccaacattgtgagaccctcatatctactaaaaatacaaaaattggccaaacgcggtggctcacatctgtaatcctagcactttgggaggctaaggtgggtagatcaccagaggtcaggagtttgagaccaacctggccaacatggcaaaaccccatctctattaaaaatataaaaattagcctggtgtggtggtgcatgcctgtagtcccaaccactcgggaggcggaggcaggagaattgatttaacccgggaggaggaggttgcagcgagccaggatcgcaccactgcactccagcctgggc

SEQ ID NO: 9243 - DNA, 518 bp, Homo sapiens
ggctggtcttaaactcctgacctcaagcagtcctcttgtcttggcctcccaaagtgttatgattacaggtgtgagtcaccacacccaacatgtgtctatatctgtagatacagatacacacaccatttctacctgaatatatagcaatatatatgtgcttccacattctttgtctacatgtttttttttcctccaggatgaatctgtgatgatgaataaaaaagtgaataaaaaagttatttttattcaggtgtagataaactacttctgtttctctcaagctgctataacatgggccatcttgtttggttagaatgtatagtcaattccttagaatccagaagaggagtcattaattcttgctggaagataagggccaagctgtaacttctggcatatggaggaagatcctgactcaggaacaagtacatcacacttggagtcatgagccctcatttggagttccaattctgttattacctcaataggtgaaacccatgcttctgcgtactctacca

SEQ ID NO: 9244 - DNA, 479 bp, Homo sapiens
aacctagaattatgttcccagtgaaataacttttaaacataaaggcaaataattcattttcagataaacacgaagtgggtatttaccgacagaagacatagactataagtattgttaaaggcacttcattaggcataaaattatgataccttataaaaaacaaaatttatgaaagtaaatgaagaacacaaaaatgttataactgtgggaaaatgtaaataattgtattggatttttaaattgtatctaaagagaattgagtaaatagaataaaaaactgatactaatagacaatatctaaaacaaaattggcaggatagtgaccgcagcaaaatgatggattaagacttttcagcaattatctcctcacagaaacgtcagtttgaacaattatccatccacaaaaatactttcacagaactaaaggatgcagataagatgttacagtaccaaagattaacatggaaattaaaattaat

SEQ ID NO: 9245 - DNA, 365 bp, Homo sapiens
tagttttcaaactctggcaactctgtgaaaaatagagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttc

SEQ ID NO: 9246 - DNA, 285 bp, Homo sapiens
  misc_feature 79: n = A,T,C or G
ggtcacaaaggtattgacttttggtcagaagttccagggggcgagaagaatgaactaactccatgcattctttttgtgnttttggttttggtttttttgagacggagcttcctcttttgcccagctggagtgcggggctcaatctcgctcactgcagctccgcctcccaggtcacgccttcttctgctcaggcttcgagagctggactacagggcccaccacacgccagctaatttttgatttttagagagacgcgtttctcgggtagcaagatggctcgactcc

SEQ ID NO: 9247 - DNA, 318 bp, Homo sapiens
atgacagaaaatgtttttatgctgtacatgccttttgaacatttttcaaaatacttgtaactttgaagaaagtgtgtatattgttagaaggctgtaaggagagcaggtctctgctctggtggtgattttactcaagaggggatgtgaatatttatatttttgtgtggatttctgtgtaggagtttttgtatgtatggaagaaagagaagaaaatactcaaatacctgaggataatttgctcaggagtcaaagtgataaactagtttaatgaattaaagcatggttttccatgacaatttttaattacatcctttgcca

SEQ ID NO: 9248 - DNA, 100 bp, Homo sapiens
cccactctgtgagctgtctgtggctccgcctacacacagctcctcaccctgaagctgctgggttcccctgcatcacacgcccaccttccccagtgaaccc

SEQ ID NO: 9249 - DNA, 365 bp, Homo sapiens
gctgtcgatgagagtactgaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaat

SEQ ID NO: 9250 - DNA, 99 bp, Homo sapiens
ttcttctttcttcctaacattttcatgtgagatccagaaaggacacattgtctctggccattcgaagaaagaaagaaagaaaaaaaaaaaaggttttta

SEQ ID NO: 9251 - DNA, 350 bp, Homo sapiens
cgttgatgggacctcagagtcacttgaggaagcaacatttgagcagcatctaggagccttctgggaaaagatggagaaaactaaagacgttaggtttattgcaaaccaatcaatcatactcactgatcacctactagaggaaacctgtgataacacttgtggggagatttatagaaagaagacgtatttgcacatcaggattttacatcatgatgtgtgcctgtgtgtgtctgaaaaatactagcataacaagctggtgagtacactatgaaaaaaaacaacaacacctacttcatttggcagagcaccagaaatgagggggtaatgaggtcctgtctttgtggcatggt

SEQ ID NO: 9252 - DNA, 395 bp, Homo sapiens
ccgttgctgtcgttgtccttttctaatagttcgtgttttagaaattcagaacaaacaatttctgaatgctcctcagaacgccaactcaggcagagaatctcaccgaaatagagaagaagctcatgctcctggaagaaacagcccgaggagagccgctgggccacatctggccactgtccgcagcgctgtcagattgctggggccacatctggccactgtccacagtgctgtcagatccaaggagagccgctgggccacatctggccactgtccacagcgctgtcagatgccgaccaaaccctgctttggtgttgaggtggttcgtctggtagcctcctttcttaagggtatttaatctgctgcaaattgttttcatgtatgcaatagatgttact

SEQ ID NO: 9253 - DNA, 446 bp, Homo sapiens
attccgttgctgtcgataccaagtgctctacaaggcaacctgtgagcccagactggatcctggaccagaaaaaggacactagtgagacaactggcagaatttgcataagaagcacggcctcggcctcgggtggtggagtcactgctgagcccatgacgttctgcttatattccatccctgcatttggaagtcgttctttgccaggaggaaagtgaggaaaaaccagcaataacaaaacagcagctctactgacggaggaggaggagcccaggaggcggctggtcagggcccaggtgtggagggaggccaggcataggcaccccgacttctctggaactactgacattttctcgcaagcagagaggaagatggaaaggtcagggaggagaatgagggaggggtctgccgcggggagccacaaactccgtggggcacagaaagtgcaa

SEQ ID NO: 9254 - DNA, 394 bp, Homo sapiens
tctgtacagcagcagtcacctattttttctcgttgaatattttcgatccatggttggttgaatccacagatgtcacactcacagatatgaaacccacagatagagagggcttactgtacttagatggaaagtaaagaagaataaaaggagttagagagaggccggaaggatcttttagaaaaggtggttgggaaagaactttctgtgctggtagcatctgaccagagacctgaatgatacaaagaagctaatcataccaagatcagaagggacaatgaactcttaacaattgttcctctgaaacaagttatttgtagaaggaaaacaaaggtaacgacagtataaaaaagaaaagaaaactaggccaggtgcggtagctcacgcctgtaatccc

SEQ ID NO: 9255 - DNA, 609 bp, Homo sapiens
gagactttttttatcagactgaaatccgtcctgcctttttagaatgagctcatttttcttcactccagctaatgctgacatttaccaaatccagtcctgattaagtaagcttccatcaccaagaaaactggaaaaaaggtaggattcataagacagtggattcccatccagtgcttgtagctctgttatcctctttagaagtatctgagggttaacaaaattggaaattgtagaggaaacaaatttgcactgaatttagacctaatttacctgaaaatgggattcctttaaaatccacagtgagcccacagttttgtcctgtgactgagattcagtcacaccttgaccatgtatttatttcataaattaagccttcaggccaggcatggtggctcacacctgtagtcccagcactttgggaagctgaggtgggtggatcacctgaggtcaggagtttgagaccagcctggacaacatggtgaaaccccatctctactaaaaacacacagtactaaaaaacatctctgctaaaaacataaaacactacctgggcatggtggtgcgcacctgtaatcccagctacttgggaggctgaggcaggagaattgc

SEQ ID NO: 9256 - DNA, 619 bp, Homo sapiens
aacacaagtcaaagacaagtgtcaacatgctttcaaccaacattaatgaggaaacaagacacaaattctttttctttttttattttattttatttttgagatggaatctcgccctgtcgcccaagcttgagtgcagtggcgtgatctccactcaccacaagctcctcctcctgggttcacgccattctcctgcctcagactcctgagtagcggggactacaggcgcctgcaacaacgcctggctaattttttgtattatagtagagatggggtttcaccgtgttagccaggatggtctcgatcttctgacctcgtgatatgcccgcctcaccctcctaaagtgctgggattacaggttgagccactgagcctggccctgtttgttcttttacattaactttacaatatatttgccatgttctaaaaatgaatttaattggaattttattgaaattatatgagacatgatttagtccaagatgaacacacaacattattattactctttccatccagctatggcatatttctttgttttctctagttggcctttgtatcgctcaataaaatttgtggctctggtatatttcataataatcatacattatatttcattatt

SEQ ID NO: 9257 - DNA, 290 bp, Homo sapiens
ttagcattttttcccactggttctaaatgaaccccatcctccttactttaaaccttcagaacagttgcctatagatagagttattagtcagacatttgggaatatctaaactacagaggaatgctgaggaattgtagctacacatgatgattgcaatttcaaggaaagggaatttatgctgaaatatttgaataacttcccctcttagtttttactatgtcaaaaaaattcatgtaaatgtatccctttacacaattggtctactgaaatttttggtgaaactaaaacac

SEQ ID NO: 9258 - DNA, 466 bp, Homo sapiens
atctaagatgatcattttcccactcgaactgagtgaaaaaggtgtttattgttgcagaaaacatctgcgtataggtattggatgctagtggtgcatatatgaatacctatctctgctcttcaggtggtcacagtccactgggggagaaaaacacagatacttagtacaatttattctatactgcagatgtgcagagtgctgtgggtatgtagataactttaagctgaatcttggtcggtgagcaggtgttcagaagatagacttagtggccaagtgcggtggctcacgcctgtaaccccagcactttgggaggccgaggcgggtggatcacttgaggtaaggagatcgagaccatcctggccaacatggtgaaaccccgtctctactaaaaatacaaaaattagctgggcgtggtggtgcatgcctgtaatcccagctactcgggaggctgaggcaggagaagcgt

SEQ ID NO: 9259 - DNA, 92 bp, Homo sapiens
gagcaagactccatctcaaaaaaaaaaaaaaaaaaaaaaaccccggcccggggaccaaaaccgggaatcccaggaatttggggggcccgggg

SEQ ID NO: 9260 - DNA, 372 bp, Homo sapiens
cctcccaagtcgctgggactacaggcccacactaccacaccagctaatttttaaatttttctgtagagatggggtctcactgtaatcttgaacagctggcttcaagcaatcctgccgccttggcctcccaaagtgctgggattacaggcatgagccactgtgcccacataacaatgtttcttaagtgaatacatgaatagctcatcatctatggaatactgtgctttacaccaagtagtttgcatttattatttagtattcataacagtctacctgcaaccattgcttttcctattttatagaggagccagaggctaagtaaattcctcagtctcacacacagtgaatggcaaagcctgggttcaaattcag

SEQ ID NO: 9261 - DNA, 573 bp, Homo sapiens
aatatttatattgacagaaccatattttcccaaagttaatgttatttctgggtgataaaaatgggcatttcttgataggaatttggtcctgtatctaagattaaacttcctttctcacatacatctgctctgtgttgccatataagtgatgggcagtaatgacatttttgaaatcactcaagccataatcctgctactccctcattccttacatagagatggtcaccaggaatactatctagttgccaatccctaatacctctctaatcaaggcacttgtttctttctcaccgtcttagttaagatatcctcatcattcaccagcagtttttaaactccagtgagcttcagaatcaccctccagagcccaggaaaaaatccgaaggaccagcctctacccaggaggttctgattcaaaagggaaggacaggacaggcctggtggctcatacctgtaaccccaacactccaagaggtcaagtcaggaggatcccttgagcccagaagttagagaccagcctgggcgacacagtgagaccccatatctacaaaataaaaaataaaaaaaaaatta

SEQ ID NO: 9262 - DNA, 487 bp, Homo sapiens
  misc_feature 420: n = A,T,C or G
ctactgtcattatgtctggctaacaggagaaactctgtgagtagctattaattaacaaagacaaagcacattaaagagaaaatggaaggagggagggaggaaggaaagtaaagtttgagaggaaaagaatatagattcataagtcctggggataagtaatgaagccttatgcttgctatattttttctttctggaaatatagtagttgtctgtggtgaaagaagaaagaagaaattacttgaacaaagagtttaaataaagacttgactattacaatgttaatgccaacatactacccaaaacagtggattgcccataataggttccataaatataattacgtttgattaaatcaaactggaaataccacagatttctggtattcttcataccactccaaaaggataataacagtaatanagtatttcatatatatacacacacacacacacacacacacacacacacacacacacacacacacaca

SEQ ID NO: 9263 - DNA, 612 bp, Homo sapiens
acagaaagtttcacgcaccaagatccatcaggaactataaaatgtttgttgtagaatctggcactgtacatacccactaaggcaaggcagatatggaagagtctgagatgacagtagaaatttagactgttggtcaaggcatgttgtctccaaggtaaaatagttttcgattaggatataggaaaatagaactatgtggcgttctgagaagagtgaaattcccagcaggtggtaaagcctagagatgcagactctagatgggcaatttccacgttcagtgttttagtcatatctcatttaatgatcagaagcaggaagtcatgaaatctagcttaagtataaatcaaaataagagttacgttgaggccgggcgcggtggctcacgcctgtaatcccagcactttgggagaccgaggcgggcggatcacgaggtcaggagatcgagaccatcctggctaacacggtgaaaccccgtctctattaaaaatacaaaaaattagccaggcgtggtggcgggcgcctgtagtcccagctactcgggaggctgaggcaggagaatggcgtgaacctgggaggcggagcttgcagtgagccgagatggcgccactgcac

SEQ ID NO: 9264 - DNA, 358 bp, Homo sapiens
ttatgactttgactatattttacaacttgaaaaattttcatttttatggtgccatcagcctgctacttaatagaaaatgttttattgacatttatgttctttacctaatgatgtgtatttaaatgatggctgtcatcttcattagaactgactgttgaaagagtaataagaatgagaatacagaaacctggtctcattttaattgtacaaactgagaacataacattgggctgaacatttcaccaatttgactacaacatttaatttaaaaataatatatatctccaatattgtatgatcattattattgtgatttattatgcttactgacacatgaaatatatgtatatatgtatat

SEQ ID NO: 9265 - DNA, 91 bp, Homo sapiens
aggatgactgctggcaactgctgatgaaggagaagaagttgcttggaggtcctggggcccgtggcaagacaaagggaatttggtaaaggag

SEQ ID NO: 9266 - DNA, 313 bp, Homo sapiens
ggcacgaggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagaaggagataacatcttacc

SEQ ID NO: 9267 - DNA, 314 bp, Homo sapiens
cctgagtgacagagcgagactctgtctcaaaaaaaaataaatgaataaaaaataaaacagcaactcttgcagatttcccgaatgtattggtcccagagaacactgaaaataatgtcatgttgttaacaccagtgggagtttgggaaataattccagctctttaatacttctttcagcttcagattaagtgaaatgagtttcacatatttcaatatatgaaattttatgatgacacataaaacaggccaggggttattgaggacacatctgtgagatagtgggcaatgctacatattcgttagtggatgtgctgc

SEQ ID NO: 9268 - DNA, 183 bp, Homo sapiens
ggcacgagccagctacactggaggctgagtcaggagaatcacttgaacgtgggaggcagaggttgcagtgagtggagatcgcaccactgccctccagcctaggtgacagaatgagactctatctcaaaaaaaaaaaaaaaggttttcgttggggggttgctcttttgggggcccaaccccttg

SEQ ID NO: 9269 - DNA, 542 bp, Homo sapiens
ggcacgaggtttccttctcctccctcccgggacaaggtgtcatatacaatgtcattgtttgggacccgtttctaaatacatctgctgcctacattcctgctcacacatacgcttgcagctttgaggcaggagaaggtagttgtgcttcccttagaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcatt

SEQ ID NO: 9270 - DNA, 118 bp, Homo sapiens
ggcacgaggtacttcctaggagtggttgcatttgggaatggaattgttaaaacttgatgcttaggagcgaatgcagactattcattgggtgtttggggtgggggaagggggggtgggc

SEQ ID NO: 9271 - DNA, 533 bp, Homo sapiens
ggcacgagggcagagtaagtacggtaatttctgcacccgaatgggtagtgttgcctttgaagtagtcaccttgggaagatgtatgtttattccagtgaagctgaccttacacagaacattcctagaaccctctttagaaactgtcaacttgtaagggtcttcagtgttggtaaatctttgtcctttaagggtagatctattttttgaggaatgatttttttttttaacagctaaagagcattagaaaataagtctgctaaataaaatgggtgaagcagctcaggatgatcttggtgggcaggaggaggggttggataaaacacaaggtctgactataaagttgtgaggcctcttgccttgcatggcttcaaaggtaatcccaaaggggaaccctaagtgttcttggcacatgcaacatcaagaaaataactccaattatgctaactcttgagtgcatatgttctagtgtatttggttaaaaaggtggctttgttcattttcagtcatatttcgtataagcagaaatggaaaac

SEQ ID NO: 9272 - DNA, 304 bp, Homo sapiens
tccattatctagttgtcagttcttatcttacttgtctgcccctggcactgttcttcacagttgtactcgctcctttttgcttccaaattacattttcctcatctggtactgagctccctgttaactttctttactcttggttttagcatttccatttccttgaatgtgccagagctctgtcctctgggtctttgtacaggttgttccttgggcctacaatactcatttccaaacttttcacttaactaagaattgcaggcctcagcattaatgctacctgaagctttctctaatcctcatttaa

SEQ ID NO: 9273 - DNA, 427 bp, Homo sapiens
ttatctattgctgggtaagaaattactacaaaacatagtgactttaaacacttgatcttagccaaaggccgagaagtgatatagtggcttaaaaaaatatgtacatatgaacttagtatatttttacccagagcactaaaggtgaccctaattgattttaaatccctgaaacaaggtgtcctgtattccaggccatctattgtctgtagatttgcaaatctttggattcatttctaagtgtaccagtttcttcacactttaaatgttcacacttttaaatgttcatgctttaggctgggcgaggtggctcatgcctgtaatcccagcaatttgggaggccgaggcaggcggatcacctgaggtcaggggttccagaccagcctggccaacagggagaaacccagtctctactaaaaatacaaaaatt

SEQ ID NO: 9274 - DNA, 578 bp, Homo sapiens
tagattatttcttcttaattaacagtacaaatagaatatgtcttctgactagagttaataaagacttctgactagagttaataaagacaagatgactcattaaaacaatggtactaaatattaaacacttattttatttctctcaacctccaatcacgagcccccagttaaatgcattaaggaattttatttatttatttatttatttatttatttatttattttgagacggagtctcgctctgtccccaggctggagtgcagtggcgtgatctcggctcatggcaagctccacctcccgggttgatgccattctcctgcctcagtagctgggactacaggcgcctgccaccacgcctggctaattttttgtatttttagtagagacagggtttcaccgtgttagccaggatggtcttgatctcctgacctcatgctccgcctgcctcagcctcccaaagtgctgggattacaggcgtgagcccccgcgcccggcccgttttaaggaattttaagggcatcaaacttatttcaccagggtagataaataagatatatttataatctcaggtatgaaag

SEQ ID NO: 9275 - DNA, 159 bp, Homo sapiens
cccaggagggttggccggacacagtggtagtggctcacacctgtaatcctaatgctttgggagcctgaggcgggaggaccccttgagcccaagaggtcaaggccacaatgagctatgatggtgccactgtactccggcctgggcagcagagcaaaaccc

SEQ ID NO: 9276 - DNA, 559 bp, Homo sapiens
cacccaggctggagtgcacgggcacaatcatggctcactgcagatccaagctcctgggctcaagtgatcctctcacctctgcctttcaagtagctgggactacaagtgccagccatcccacttggctaattttgtttcaagagatggggtctctcaatgctgcccaggctagtctggaactactggccttgagtgatcctcctgcctcgggctcccaaagtgctgagattataagcttgagtcatcatgccaggccagatggtgcacagtttttaaatgaaatatttaaatcatataaaaactcatggggaataatataacgaatataatacgatacaatgcatacaatgaacaacacaatggcctaatatatgacaagtcacctttattatctatggacctctttttacccctccagctctccccaccaatgaaaaccattatcaggccaggcacagaggctcacacctatgatcccagcactttgggaggctgaggcgggcagatcacctgaggtcgggagttggagaccagcctgaccaacacggagaaacctgtc

SEQ ID NO: 9277 - DNA, 521 bp, Homo sapiens
ccaccatgactggcaaattttcgtattataagtagagatagggtttctccatgttggtcagactggtcttgaactcccgccctcaggtgatctgcccgcctctgcctcccaaaatgctgagattacagatgtgagccactgtgcccggctgcctgagacattttgggcaacagccgtgacagaagaaacgtgcatcccttctgtgcaggggatttaagaagtggctcatggctgattatgttttctttgctccgtttctggaactgtgggagcatcttctgggataagggtctatctgtttgagtctctgaatgactacgaccaccagagcccccttgttggcccgtgatggatgcgaaatcaattcagaagtaaaggccgggtgcggtggctcacgcctgtaatcccagcactttgggaggctgagacgggcagatcatgagttcaggtaatcgagaccatcctgactaaaacggtgaaaccccatctctactaaaaatataaaaaattagccaggcatt

SEQ ID NO: 9278 - DNA, 584 bp, Homo sapiens
cctttactacttcttggttttctgacactgagaaggtcatttagcttctccagatttttgttttctcatgtgcaagataaaggagttgaacaaagacagtggttttcaaactggattccgaggaaccctagggttccaagaagacatgatggtgagaagagcaaggcaaaagggaaagaagacaattgttaatgagcaggacccccacttctacccagattgctccttcttgctctgttttgtctaccatgcttccacacaatactacacttaatcaaagggttttggcagggcacagtggctcacatctctaatcccaacgctttgggaggccaaggaagatggatcacttgagctcaggagtttaagaccagcctgggcaacatggtgagacaaaaaatataaaaattagctggacgtggtggtgcatgcctatagtcccagctacttgggaggctgaggtgagaggattgcttgagcctgggaggtcgaggctgcagtgagccgagatttcaccactgcactccagcctaggtaacagagtgagaccctgtttcaaaaagaaacacacatacacgcacccc

SEQ ID NO: 9279 - DNA, 448 bp, Homo sapiens
tatttttgcgtggaatataataatatctgaaacctccacaggtcctttatacataacattctacctacaaataagagtcactacacatgtgaagcagcaatgtcatatgaccaataatcaagaggggaaaaaaaaagcaaaacaagcaaatagatgatctgcataattgaagttaacagacaagaactttaaaacaaccataattgggacttctggatagctaagggcataacagctgcaccatttagctatatgcctccctgtatttcctccctaaagaattaaaaccaacaaaaaatggtatgtaaatctagacgaaaccatgccttcggcataacttgaagacagagaatgctaaaatattaaaatgaccgtgactaggctgggcacagtggctcacacctgtaatcccagcactttgggaggctgaggcaggtggatcacttga

SEQ ID NO: 9280 - DNA, 565 bp, Homo sapiens
atctgtagaagcaactgaggcttcacctatgatgaaagactttggagtcagactgcttaggtttaaatcccagttccattatttatctatttgccttatgactttggaagttacttaacttctctattcctgtttccttgtctgtaaaattaggataataattgttcccaaatcataaagttgttatggggagtaataagatagagtgtgtaaaatactccatacagagcctggaccatagttaagagtaagtactctacaaaaacttgtttttgtcattagagatacaataaaaagttatgaaccaaagtggccagtaaaaaaaatgaaagtttttatatactgagcatctataatgtgtcagtcattatgttaaccagttttcatacattatttcttttaattttttgtcttcgaattattttaaaagaattaaaagaacacagtatgatttaatgtgaaaacgaaaaagagaagattccagctgggcacggtgactcacgcctgtaatcccagcactttgggaggcctaggcagttgaatcacgtgaggtcaggagttcgag

SEQ ID NO: 9281 - DNA, 547 bp, Homo sapiens
  misc_feature 322: n = A,T,C or G
gagcagaggtcagggcttcatataaacagcctggtccctaactgcttcccttctgcagtcaaccccaggaatggactttttgttcagtgtctcctttcatcctctttgaagagatgcaaatttgaacagacggtgtcgctgttgggaactgttttgtccctgccatcaattgtatgttcctctctgtgattatctggtgagacagtgcaaaaatagggacaaaactaacaggaaaaaatacaaggaaacaggaaactctagcgtacaggagttggccagcataatttatttttttcttatgcatggtcatgctatgtggttntgtaaacttcctttttaaaatcatggttgattgaacatttaagaaaagttttgactggacacggtggctcacgcctgtaatcccagcactttgggatgccaaggcaggtggatcacctgaggtcaggagttcgagaccagcctgaccaacatggagaaatcctgactctactaaaaatacaaaattagccgggcgtggtggcgcatgcctgtaatcccagctact

SEQ ID NO: 9282 - DNA, 287 bp, Homo sapiens
  misc_feature 130: n = A,T,C or G
caatctcggctcaccacaacctctgcctctcgggttcaagtgattctcttgtctcagcctccggagtagctgggactacaggcgcacgccaccacaccaggctaatttttgtatttttagtaaagacggngtttcaccatgttggccaggatggtctcgatctcctgacctcgtgatccacccgcctcggcctgggatgacaggcgtgagccaccgtgcccggtctaaaattttattttctacagttctaacacccagaagtgagattgctggatttttgatttctg

SEQ ID NO: 9283 - DNA, 216 bp, Homo sapiens
attcttttatctcatgtagatttcaaaggctgaaataattgagattttttagtttgaagaaaagagaactgaggatttaatgtacattattattatatttttaatggactgtttgggagtaagttgcagacattgttcactttcactcctaaatacttaaatatttcctaaaaacaggacattcttttttttttttatggagtctggctctgtcgt

SEQ ID NO: 9284 - DNA, 329 bp, Homo sapiens
cacgagattttttttgttcgaatgagccttaatcttttactagtgattttttgtttgaaggagccttgatcttggaccaccgaaaaggtgaaaccagtggcaagcttgaatgcttgttttatggtagacttagatacgagaacgggtaaagggtactggataaacttgggatataagattgtcttcttttatgcataccactcataccactggtgggaaatttcatttggaattactccctagggccatggagtcttcctgcatatgctaataatgtaagttcccattacctttggtaataagaaaatatctttaaaacaagttagctt

SEQ ID NO: 9285 - DNA, 420 bp, Homo sapiens
ggaacaaatcacttaaggagaaagtagaaaaaaagctgtattttatcaaagaggtattctaatcggcaagacaatgaccaaccattacgaccaaccattatgagaatatagcttagggacgtttgtgctcagctcctcttttacccaatgtcaatgcctgcctcagtgtattttcttctggaggagagttttgtggatgccatctttccgttacggaaaaccattggaggaatgggcagtttcttgccatgacccaccatcatttaaacaattggtgtttgagttcagaaataagctcatatatacttgaattccatgggttaaataagccattgagttaaagtggtaagaaattaaaggtagaaaatagaagaatagggtgggcttggaggcttatgcctctaattccagcactttggg

SEQ ID NO: 9286 - DNA, 78 bp, Homo sapiens
ggcacgagagcaattccactcctagctccacccacaggaattgaaagcaaagacgcaaacagatgcctgtgcaccaaa

SEQ ID NO: 9287 - DNA, 646 bp, Homo sapiens
tccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaa

SEQ ID NO: 9288 - DNA, 300 bp, Homo sapiens
ctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagagg

SEQ ID NO: 9289 - DNA, 53 bp, Homo sapiens
cagccgaggggtccggccagtctctttctcaaactgggagaagctggatgccg

SEQ ID NO: 9290 - DNA, 317 bp, Homo sapiens
ctgtcgcccaggctggagtatagttgcgccatctcagctcactgcaacctccacctcctgggttcaagcaattgtcctgcctcagcctcccaagtagctgggactataggcatgtgccaccatacctggctaattttttttatttttagtagagacaggatttcactatgttggccaggctggtctccaactcctgacctcaggtgatccgtctgcctggactcccaaagtgctgggattacaggcataagccaccatgcccggcctacaaaaaatttttaaaaaattagttgggcctctaaccccagcactttggg

SEQ ID NO: 9291 - DNA, 207 bp, Homo sapiens
gcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggccca

SEQ ID NO: 9292 - DNA, 475 bp, Homo sapiens
tggcaccattgtagggatctttctctttctcctgatctcaaagaaaaggtttctatatttcaccatttctatatttcaccactaagtataatttttgctgtaagttttttgcagataacttccatcagaatagagaagtttgccaagagttcgtatctataaatgaatgttacttttataaaacattttttctggctgggcgcggtagctcacgcctgtaatcccagcactttgggaggccgaggcaggcggatcacgaggtcaggagctcgagaccagcctggccaatatggtgaaaccccgtctctactaaaaatacaaaaattagccaggcatggtggcacacgcctatagtcccagctactcgggaagctgaggcagaagaattgcttgaacccgggaggcggaggttgcagtgagccgagaacgcgccactgcactccagcctgggcgacagagcgagactccgtcccac

SEQ ID NO: 9293 - DNA, 497 bp, Homo sapiens
ggatcaaaaggagacttaagtgattgagaaaaacatagtggaatccggaaagaatgacacctgaaacaaagatggtgagtataataacccatctatcctgtgtgtggttgttttttctcagaatgagggagaagctataaagcaaagatctttatctttatttacaataactcataagtaatataaacactgacttggctcttattataactgtatctagggtaccatgaactttgagtgactgagtgaagatggcagacccatactgtatctaactatagacactttttgaccaataaacaatggggcttgcagccaggcacagtggctcatgcctgtaatcccagcactttgggaggtcaaggccggtggataacttgaggtcaggagtttgagaccaccatggccaacatggtgaaacaccttctctactaaaaatacaaaaattagcctggcgtggtggcacacacctgtaatcccagctatttgggaggctg

SEQ ID NO: 9294 - DNA, 562 bp, Homo sapiens
tccagttgtgctgagacagagcaatgggtttccttcttttacatccttgtgcattgctctattgttatggatgataaatttctaaaagtaaaatcactgggacaaaggatacacacacacacacacacacacacacacacacacacttttttgtgacaggatctcactctgtcacccaggctggagtgcagtggcgcaatcacagtttactgcagccttggcctcccaggttcaagcgatcctcccacctcagactcccaagtagctgggaccacagcgcacaccaccatgcctggataattatttttctcagtttttgtagagacacggtctccctatgttgcccaggctggtctcaaattcctgggctcaagcaattctcctgccccagcctcccaaagtgctgggactataggaatgagccaccgcacccagcctgggtatgtattttataaatattgtgctaacttcaaccaagtttttgattagagctgaacagcacacaattaaaataagatcacttttgaatacttgaaggatgacagatgtctagttcattagt

SEQ ID NO: 9295 - DNA, 116 bp, Homo sapiens
gagcagaggccccaggtggagcaagttggcaaacaggctcctctctccccagggctgccggcaatgggggggcctggccccggcccctgtgaggaccccgcgggtgctgggggagc

SEQ ID NO: 9296 - DNA, 535 bp, Homo sapiens
tcaccttcaatggggaaaacaaactttgtaatggtaggaaacacaacaggtacaataatttacaaaaatatgtttgccacatttcagggcaaggcaaaatgcagtggagacatatgttaaattcttatcattcacatttgttctttttatctttaggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggac

SEQ ID NO: 9297 - DNA, 509 bp, Homo sapiens
tttggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagc

SEQ ID NO: 9298 - DNA, 585 bp, Homo sapiens
gaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctc

SEQ ID NO: 9299 - DNA, 227 bp, Homo sapiens
gatgggggagaggggcgagaaggggaaaaatgggaaatagtctgattttaatgaaatcaaatgtatgtatcatcagttggctacgttttggttctatgctaaactgtgaaaaatcagatgaattgataaaagaattccctgcaaccaattgaaaagtgttctgtgcgtctgttttgtgtctggtgcagaatatgacaatctaccaactgtccctttgtttgaagttg

SEQ ID NO: 9300 - DNA, 75 bp, Homo sapiens
ggcacgagcagtctcctgccggaagaaatgggttgagcccgaaagaggctgtctgaggaagggagagggagggcc

SEQ ID NO: 9301 - DNA, 332 bp, Homo sapiens
gtctgatcatatatcctgatttttaggtaagaatacatagccatgacagcaagagaatatctctgcagcttctgatgtacactgaagagcaaaataacttaagacatgtaaagttaggtgcctcaaaaagtaaacactgcatgctcccaaggggaaaaacaattctacaaaacagagagttaaaaaaagagaaagaggccgggcacagtggctcacgcctgtaatcccagcactttgggaggcgaggcaggtggatcacaaggtcaggagattgagaccatcctggctaacacggtgaaactccgtctctactaaaaatacaaaaaattagg

SEQ ID NO: 9302 - DNA, 473 bp, Homo sapiens
tactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaacgttctgtttgtctccggtcatcacactgtgcctcaggattgtgttgtgctatacacttctggtccaagatctgtaaacctgtcctgaaagaaggtcaagtgtgtaccaagcatatgagaaaaggctctcatggactagaaatattccagcgttgttactgtggaaaaagtctgtcttgccggatacagaaagatcaccatca

SEQ ID NO: 9303 - DNA, 675 bp, Homo sapiens
gctgtcggcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcacc

SEQ ID NO: 9304 - DNA, 473 bp, Homo sapiens
tcacaccagagcttccaccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctc

SEQ ID NO: 9305 - DNA, 236 bp, Homo sapiens
ggccccactgtgtccccgactaccacaagcagtacgccccgaggtgctccgtctgctctgagcccatcatgcctgagcctggccgagatgaaactgtgcgagtggtcgccctggacaagaacttccacatgaagtgttacaagtgtgaggactgcgggaagcccctgtggattgaggcaaatgacaatggctgcttccccctggacggacacgtgctctgtggaaagtgccacact

SEQ ID NO: 9306 - DNA, 272 bp, Homo sapiens
tgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtgacagtgatgac

SEQ ID NO: 9307 - DNA, 255 bp, Homo sapiens
gcttggttgtcggcatccttcttacgtcgggtggttttactggagtattgggactcatgtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggcccc

SEQ ID NO: 9308 - DNA, 242 bp, Homo sapiens
gctgccactgtggagcagttcgttttgaagtttgggcctcagcagacttgcgtatatttgactgcaattgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaacccc

SEQ ID NO: 9309 - DNA, 85 bp, Homo sapiens
cagtggtggtagtggcggtggcagcatgatgggcggagagtctgctgacaaggccactgcggctgcagccgctgcctccctgttg

SEQ ID NO: 9310 - DNA, 434 bp, Homo sapiens
tgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgcagagtgggaatgacagtattgacctcacggagctgtgaggtttctctgggatgcagggcaggcactcagtaaatggtagttactgtgttctggtctgtgccatggcgggcagcagctg

SEQ ID NO: 9311 - DNA, 533 bp, Homo sapiens
cgataagaaattgcactggccatgtaggggaagctcgacatgaattatgtagttcatttaaaatgcacatcaaagagagaccactttgtttaacataagtgaactctcccttcaattagatacaacagttactgaactattaatatgtatacaagaaaattaatgcggttggattcttaaggaaagcattacagtatattaaaggtgtaaattcaaagagactcatagttattgaatacactaaaatagttaatattttaggttaaaatgtaaacttatcacctaatttaataatgatgttatactaaacacacacatacaagtatattaagattaaattaaaagaatttgctgcttgccccaacaaatatttgcttctggaagctaagactatgaaacaactatttacttacataaatcaagtgaattcttcaagatttctttcaagacattgttctgtgcctcccaatccaagctaggatgtgataaactaaactccacccatagataaacttcaccctacaagtttaatc

SEQ ID NO: 9312 - DNA, 480 bp, Homo sapiens
tatattgcccaggctggtctcaaactcctagacttaagtgatcctcctgcttcgacctcccaaagtgttgggattacaggcgttagccatcacggctgacctcttctctcactttttcagcaaccatgagtcctctgaactctgttgtctggttcttcatgccagaaaatttgtgggctttctatcagaattttgatgctcaagcactgctggctacagtctgccctcatgctgaaaactgtcaaaacagaaaattcacctgttatagcgtttttttgtccttactccaaaatttgcctgctcttgttcagtatcctgagccttcagggtagctgcttttgtcttttgtccagagtttatagatgtaaactaaagttcagtctggtaaggtttgactaagccattctggaaagaaactcttcttccatcatttctttaaagtaaaattatattaagtgctgagagtaagacatagtaatg

SEQ ID NO: 9313 - DNA, 376 bp, Homo sapiens
ccgaaatacaagtctgtgaattggaatgctgttaagaagatatcaacagagtcacaggagtacaaaggatcaggcaaatatttctgacagatgggaagttaaaaaggcttcatgaggaaattgcttctaagcttggcattgaaggaagagattttattttatttttagtatgtatgtatttatatctcattgccttccagaaagattttgaagtaacttataaaaatacatatatcccaataggacagaataattaattcaggcaatctgactaaaaggggaaaattatgtgtatgaaattaataaaccataggtaagactagatgaaagaaatgcaaaccatgggccgggtgcagtggctcacgcctgtaatccc

SEQ ID NO: 9314 - DNA, 526 bp, Homo sapiens
aagacgacagaagggtacggctgcgagaagacgacagaagggaggttaataacataacttgccctagactaaacatacacacacatgtcccatatgaacccaggagtttatcatgcaaccttctcattatgacttagctttcacattattattcatgcaggaaaagaatgctagcagtaatatttcttgacatgaattagtaagttggtagtataatttacactttttttggtcttgtgatctgatagtaaaaatcagttcattacatcatcattgggtatttgaattaagtaagttttctcccatccttaagaaaaatacaaaaggccgggcacaatggctcacacctataatcccagcactttgggaggctgaggcgggcagatcacctaaggtcaggagtttgagatcaacctggccaacatggcgaaaccccatctctactaaaaatacaaaaattagctgggcgtggtggtgcacgcttgtaatcccagctactcaggagggtgagacaggagaatcactt

SEQ ID NO: 9315 - DNA, 557 bp, Homo sapiens
ctgtgactttcttcatattctttgcatcacccagactgacctatttcagtctcctgaaatgggccacgctctcatacaccttcagacttcttttatgagcaactacaggcattcctgtgtactttgctcctctcatagaatttccttcctgtcattttttggtaaacaagctccataaatattatttgtttcagcctagacaacacctcttgggattctagaagaaaccccctttacttcccataggcgtgtactccccacagcacagtatcttcagtaccatcatagcatttatattaccatagtataatttcttcttcatttcttgggaacatgcttaaaggaataaaatgtttgagagcatagtctcttataccattttagacccagaaaacagcacatgactagctgataatagatgtcagcatagaaatattgaataaataaatagggaaaattattttagactgtaacctatcaatgtaagttccatatcaattagaattgatagtaaaatcagaggacataaaagatatagaataaaatatatgcaactt

SEQ ID NO: 9316 - DNA, 365 bp, Homo sapiens
ttagtagagatggggtttcaccatgttggtcaggccggtctcgaactcctaacctcaagtgatccacccacctcggcctcccaaagtgttgggattataggcgtgagccactgcacctggccccatgtctctaactttggatttttaaattgagataatgtggatgcgcctcacacagtatccaccatgtagtaggtggttattagcgttaatttccttcccctggtgtcccatttcttaactatgggtttgtgtatgtattttagctttcatgttcactagcaattttgctattgtacacacgaattacatggaatttctaccctaaaaattctgatagataaaactatatatgaaaaacctag

SEQ ID NO: 9317 - DNA, 481 bp, Homo sapiens
tcttttgcctttttgtgtttgtgctgcatctgtgtggcggtccccagccctggatccttgaagaagaccatatgcttctctgcaccacagcagcctaactagggcacgttcggctttcaatcatcttaaatacgtcctctgtagcccatcactgccctatgtttatgtttatctattattagatacatatttatttggaaacattttatattgaacaatagatgataaaacatagtacaatatttcagatatatttttccaaagtcttatcaattgtcaacactttgcttgtgttcattctctctctctctctctcttcttgtatcttcctgtgtgtgtatgtgtgtgtgctggaaaaaaaagagttagttttatcccttacttacatctacagataatgctaaaaataaaaatgctacactgcatgaccaaagaattgtattctcagtgaaaacttttatttggaaaaattaaaaaaaat

SEQ ID NO: 9318 - DNA, 102 bp, Homo sapiens
gttattttttagtttaactatgttaaattaaactatgttggtcaggctggtctcaaattcccgacctcgtgatccacccaccttggtcaaccaaagtgctgg

SEQ ID NO: 9319 - DNA, 273 bp, Homo sapiens
gtgaacagccacacctacctatgcacatatttttaaaaattaaaaaataaaatataaggaactgtaaaggaggaatcaaaggaaactaattatagtaaagtaacatatctttcaatagtatgtatttccacatgcatgtctagctacatgggaataatgaaagaggtgcttgcccctcaatttggagtcaccaaaaatgtgatgggtgcaaatgctgggatgtggtggggtgatcagatacctggagtgactttattgagaaaaaaaaaaacc

SEQ ID NO: 9320 - DNA, 510 bp, Homo sapiens
ttgcaaatgtaaccatccagattaaaaaagagcattccaggaccccatgagatgcccttgtattcccttttgattacctctcaccccacaaaatatactatagattagttttgcctgatttgaactttatttaaattgatcatttttaattactgaactgagccttaattataatgtgaaatgagcagaaagatatttcaaaatgtttcatgatggttctttatggccagtatttttgtatatcctgtagaaatatgtcattccctttattttcaaacctcatttgtgagattttagggatacgaatgcctttttgggactggtgtggctgtgttcttcttattaattattactgaagtaaagaggaaatgatatcagcagatgtgcagagcttttatttgcactgaatacactattcatttagacaaaaagatcatttctcaattcaaatcagaatattctaatttaaggctgaaatcagttgtgtcataatctctatggaaacaaagc

SEQ ID NO: 9321 - DNA, 345 bp, Homo sapiens
tacacggttttaaaatatgaatggggccataatatgtctattattctaaaatttgattttaaatactcaatttttttagagcagttttaggttctctgcaaaattgggaagaaggtacagagagtttccatatatacactccccgctcccccactgaagtagctgtggagtgacttgtaaagaaattgtggaaaacattccctatcagcacataaatgaaccaattatttaaaaaggtggatgaaaagccatgttgtggttataatcaacatctatttaatcagtccatatttatggacttaaagatgtttctggccaggcgtggtggctcacgtctgtaatccc

SEQ ID NO: 9322 - DNA, 641 bp, Homo sapiens
atctgacatatgggctgacagcacccatgtcaacccagtacgtcaataatgtgtggaaggcatttaatggctttcttattttaagataagaaatacaaaaataaagattctaatattttctcctcataccttgttttgtctgcccgtcaaaatacacagactggatgttggtggatccttgtctagacagcagattctgagtttagatactgcatccgaacagaggaggagacctgtatttacacgtttgtttttatttctgaacaggttccttacctctctgcacgtgtctcccgggttatactggaaatggttatgggacaaatggatgtgtgcagctcagtaatatttgcctaagtcacccctgtctaaatggacaatgcatcgtgagtcctttgtttttcctgtggacagagagtacctgagaattagtttcacgcctataaaatgtaacgttataggattcaggaatgtcaagataatgagtcaagtttcagataaggaactgtcgagaactctcagatgaaagatagataatgattttagttcttaggaaaaaacattgagttaattttttgtctcagtggtttatgaagtactaaaactacgcctgcagtttgatctaaataaatctgacatac

SEQ ID NO: 9323 - DNA, 594 bp, Homo sapiens
ttcttttaacaagtatgtaccaagtgtccatgtattagagcctatattagatgaggaatatgatggcccctaaattttaaaaaatactcagaaaatacaaaatgtaataggacatcaacggatataacagatatccatgtgatacataaaggatatcaattcaaattttcaaagcatacatgcttggctattactacagataagtcagttgaaacatcaaatgaaagcagttaagtcagttcaaagagtcttcagaaaaaataataacatttaaccacaggatgtggtcaatctcctgtcagaccacaaatagtcaccagctgcagataagtctatgattagaaatgttttcagccagcaccacagtgtattggtttgtgaaagagaacaggcaaggtagggggttggtgattagaagtgaagctgggtggccatgatcctataaatttacccattacaacaaattaaagagggcttattcaaagggctgtacaatacctctctattttggctgccaaatgcttagaagagttactttcacgcagaagtcaaaaaaaaggctggccatggtggctcacgcctgtaatcccagca

SEQ ID NO: 9324 - DNA, 627 bp, Homo sapiens
tccggctgcagggcctccttaaactcaggcaggcaatgccattgaggtgttatttctgtccctatatcagtcaaagccattgaggcacccatgggctcaagtgcctgccgacctcaagcgcagcaccatcactctgggctcagtttccccatgttccaaagactcctctgaggccctttcctgctctgaaactgctgctctggggccaggagaacctgagggctgccatgtgtcagggatttcctgtaccttcctgcctgaagcattggggtgggcaagagaagatctcctccccagctccagcctgcaaagtagcattgcagacccacctcctccgttgtctgacaagactcccagctgaccgcgccatgtggggggctggccccatgcagggtgcttcccgctcaccgcctcactggcttgtcctccccaaaacgtggcccatgcatgagcccaccattgcacccctgggtggtgtcagtgtgagtcttccaagaagacaccaggacaggattagacacgcaagagagctatggaggaaatgcctgtgtaggataaggagaggaagcgggaggagcagggaggtccctcgggtgtcaatacaggtctcacctctgtgcaaggagc

SEQ ID NO: 9325 - DNA, 433 bp, Homo sapiens
ggatgataccggctaccacaaaaacacacttagcacataggccacgacactcatgcgaaactacacaagcaattctacaaaacaaccagctaacactatgatgacagggtcaaaatctcatatattaataataaccctgaatgtaaacagtctaaacaccccacttaaaaggcatagagtggccaactggataaaaagacaagatcaaactctctgccatcatttagagatccatctcatacgtaatgacatccacaggctaaaagtagcaggatctaccgtgcaaacaggaaggaaaaaagagcactactcactattcttatatcagataaaacaaactttaaaacatcaacaaacaaaaagcagaaagaaggacattacataatgaaaggttttgatttaacaagaagatttaactatcataaacatatat

SEQ ID NO: 9326 - DNA, 63 bp, Homo sapiens
aaactattgaattatacactttatttatttattttgaggtggagtctcactgtggctctgtca

SEQ ID NO: 9327 - DNA, 368 bp, Homo sapiens
tttctttcacctgtcttaatgtctctttgatgtacaatagaaataaacaaaaggtagttgattttgcagagtgggtgagggaagaaatataaattgtttagtgcctattatgtgtagatactttatatatttttttctgagacaggtagtataataatggttaataacgtgcttagaatactgtctggtacattataaacactctgagttacaattactaattgaatcctcacaataactttataagcaaggtttactgttcttccctatttcacatttgcataaaccaaaatacagagaggttaaaggatactaagttacggccggacacagtggctcatgcttgtaatcccagcactttgggaggc

SEQ ID NO: 9328 - DNA, 68 bp, Homo sapiens
ggttaaatatttgcatggcagggggcttgagatattcctttttaacactgagcagccagttaaaacct

SEQ ID NO: 9329 - DNA, 433 bp, Homo sapiens
tcattattgtaatccacttttataggaaatttttgttgttgtgtatctccttactaaacgaacatttttttgtttttgaatctgcatcaattgttgaacacatatagaatatattaaatacatacaagctaatgaagtaacacatgaatgcatctcataccacttatcctaaaacaaccatttttttctttcattctgtcaaatactttttctctaatatcctatacttttgttactattcatggattttatctatttatagttattttcttactgatatgcaattattttctatgtatagtgtatcacatatcttgcaaaattttgtttggtttgcataatatctttttattctattgtgaatgatattatagaactttacagatgaaataaaatctgtcggccggctgcggtggctcgtgcctgtaatccc

SEQ ID NO: 9330 - DNA, 254 bp, Homo sapiens
tgaaggcatgcatttgcccagatcccttctgtgtttacacaacacctctgcatgccagggtctgtggcacagcctgctccggttgcatgatggtcttgctggtatattttgggcagggaagtcctttccagcacaacaactgagcaactttagttgtgtgaaaacagatgaacaggccgggcacggtggctcacgcctgtaatcccagcactttgggaggccgaggcaggcggatctcaaggtcaggagatcga

SEQ ID NO: 9331 - DNA, 507 bp, Homo sapiens
acctgtgaggcttgcgaaatttagttaacttacctaagatcaccaagcctgaaagtggtggagatgccaatacaggcaggttgatgcagagtccatgggattagcacaacatcctgtctccacccttctgctgtttacggtgctgtgaggaagcctctaatctatccaaagagaagtcactgaaacacttggcagaatggtgggtcccctgtgggataaataaagtatcttgaggacaaccaaagtacttcacagattcctgttaaatgattactttcccttaataaaagggatgggaaacaggttccataccttatgcttctctgttaggacagaacgagtcaggactttcagatctgcagatctggatgcccatccccattgcttcacttagaatctccatgattgaatcagtcaaactctcctcaactgtaacataaaagtgtctagctcttatgtatgagtggtatcttgctgcataacaaaacttagtttttaaagcaatta

SEQ ID NO: 9332 - DNA, 486 bp, Homo sapiens
ccaaagacctgccgggactgacaaaaagcaacaaccgataaacaagagcaagctttagcatcttaaaaatacgctcgccagagtttattttacattttcaattgaagggtggcaagataaaagtgagagactcttgtacgcgtatgcctcaagctcagaagatcaaacaattcaaatataaattccagaaagatcttttagaacagggagaaacctagtcaaaaatgaaaggaaatttcccccagctacagggaaacactgattttcaaattaaaaggccccataaagtgctggggcaggatgactgagaaatgaccccactcagacgcatcattgcaacatttcagaacaccaaaaatgaagcaaacaagtctaaaacttctagactctagagaaagaaaaataggttacttaaaaagaaagaagaggtcgggcgcagtggctcacttccgtaatctcagcactttgggaggctgagatgggtag

SEQ ID NO: 9333 - DNA, 447 bp, Homo sapiens
aggcccatctgtggtgaagagcaagatcttttctcctagcagtgcacggaagagcccagccaagtgcctcatgtagctgaagtcacaggctctgtagctaccatattcattctccacctgccagaggggagggaaagtggaacccagctatgggatggaggtcaaggaccccttgtaccttcttcccctgctccagtcacttcccccttgtacctgatgctaatgatgttgcccccattgtgataaagccatggatatatcttgggcagcaagaccttgaaccaggagtccactgcggcaaggaagtctaaaggaaggagcagagcttctgtgttaggtgctaccatcacacttgctcaccactaaatatgggaagcaatgactcttgtcaagaaattcccaaccctaagcaccttgtatatttgcacgccaatgaaatttgaacat

SEQ ID NO: 9334 - DNA, 464 bp, Homo sapiens
taaaatccagcaattgttcattatttgtaaaatagtaggttctattgattgactttattattgaataaatacattaattattttaaaaaagctcttggcaggccaagcacagtggctcatgcctgtaatcccagcactttggaaggccaaggcagaagggttgcttgagcccaggagttcaagaccagcctgggcaagagagtaaaaccccacctctacagaaaaatacaaaaattggccaggtgtggtggtgcgtgactgtagtcgcagctgctgtgtaggctgaggccggaggatcactggagcccaggaggtcaaggctgcagtgagctgagatcacaccactgcaccccagcctgggtgacagagtgagaccctgtcttaaaaaataaataaataggccgggcgcggtggctcacgcctgtaatcccagcactttgggaggctgaggcaggggcatcatg

SEQ ID NO: 9335 - DNA, 615 bp, Homo sapiens
gcagtgatggacccaggcttttgctagtgatggcagagagtgggcttttatgagtgagaagtgagagaagagatcaaaaaaacttcctggaaatgatgtttttggagctaaatcttaagggattagtaaaaccagattatactcaaagggagggaaggccacagtaggtgtgtgggagagaacagttaacaagccgtaaaacagtatgttgactacaaaagtgaaggggaggcaggaaaatgacatgcacttgggcatgactggaagcgaggaagatcacagtgagggaaagaaagaaatcaagggctacgttcttgttttggactttgatgcctgacaggtgacactaagccagaattttaagctaaatctacttgattgcaaagtcagagatttccctgctctttcactctgcctcaactgtgattgggtattgatcaagtatatctaaagctgtgtccaagaaagcccatgacattgcattgtgtgcaagttatgtgtatatgtttgcatgttcatgtttttcaggagagaagaagaagcatgaccttcttgtgattctcaaagtttaagaatcatttgagccggccaggtgcagtagctcacgcctgtaat

SEQ ID NO: 9336 - DNA, 405 bp, Homo sapiens
gctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcactttt

SEQ ID NO: 9337 - DNA, 558 bp, Homo sapiens
ctgctcagtttgtttctcagcactgtgctttgcttaaagtcctgctgtaaaactctgagatattgattagatatggacttcaggagtcatgatttttaccatcttattttgtccctgggtcatatgatgaaatacttcagttgttttttatctgtgtaattgcttcttgcattataaggtttttgtaacactcaccattcttaacccaaagcaagctttattaaatatgaaaataggtcatcaaccacatttcattttgtgtacgttaagaactattagtttggccaggcgtggtgacttacgcctgtaatcccagcactttgggaggccgaggcgggtggatcatgaggtcaggagatcaagaccatcctggctaacacagtgaaaccccgtctctagtaaaaataaaaaataaattagctgggtgtggtggtgggcacctgtagtctcagctacttgggaggctgaggtaggagaatggcgtgaacccgggaggtagagcttgcagtgagccgagattgcgccactgcactccagcctgggcgacagagcgagact

SEQ ID NO: 9338 - DNA, 505 bp, Homo sapiens
cactttaatttcctctgaatggtcgttgcaaccccccccaccgccccacccattcctaattacaagttgctgtttccgacttgcctcctggtggcccaatttcaaaacagtgattaaaattaattacctgggggccccctccccggaggggaggagccccaggagccccagagatgcatccacgtccccactggaggttctgcctgggctcccacaccctggcttcccgagtggcctggggacagggacagcctctctctgggtctctgcttgcttatctgtgaaatatttcagctggccagatgcggtggctcacgcctgtaatctaacactttgagaggctgaggcgggtggatcactagagatcaggagctcgagaccagcctgaccaacatggtgaaaccctgtctctactaaaaatacaaaaattagccaggcaaggtggcacgtgcctgtaatcccagctacttgggagcctgtggcaggagaatcgcttgaacctgag

SEQ ID NO: 9339 - DNA, 555 bp, Homo sapiens
atttttgtttttatttttgtagagacagtgtcttgttgtgttgcccaggctggtctcaaaactactggcctcaagtgatcctttgtccttgactgtccaaaagtctgggattacagatgtgagccaccatgcccagccaataagtatattccttcgtttatattaagcgttacatttagagaaattacctagttccctaattcctattttctgctcctccagctgagttacctcggagaggcaacttaacctagatttgctcactcataaaatggtaatactgcggtggctcacacctgtaatctcaacactttgggaggctgaggtgggtggatcacctgaggtcaggagttcaagaccagcctgaccaacatggagaaacctcgtctctaccaaaaatacaaaattacccgggtgtggtggtgcatgcctgtaatcccagctactcgagaggctgaggcaggacaatcgcttgaacctgggcagtgcaggttgcggtgagccgggattgcgccattgcattccatcctgtgcaacaagagtgaaactctgtct

SEQ ID NO: 9340 - DNA, 655 bp, Homo sapiens
tctgttaatatctttaaaaatgaaaaatatacttttcttgagatccaataataccccttctggaatcatatctcagaaacaaatgcatcagttctttaggataattatagaagatttgtgtggggcaggaggggagcagaggaggaaggaaagtatacactgtctataacagcaaaatttcataaaacaaagagaatgctcatcattgtggaaattactaaattaattgtgatatagcacacaatgagatacatacatagttaggcctgttcctgctgacttagagggactgccacaatttactgggaagtagatgaagagaaagtaagatgtagaagtatataatatggtctagtgttcctagctgacaaaactatctctttcatcacattcatgaaaaacagaattatacacatctagctaacagtgataaggtggggagattaaagaaaaaaaagtggctggcatggtggctcatgcctgtaatcctagaactttgggaggctgaggtggggggatcacctgagatcaggcgtttgagaccagcctggccaacatggcgaaacctcgtctctacgggatgggggggaaaaaaaacccaactagccaggaatggtggctcattcctgtaatcccagctacttgggaggaggct

SEQ ID NO: 9341 - DNA, 246 bp, Homo sapiens
gaggaaatcatccataactgcatattattttgatttagaaaaatcaatagtgtgaactctttatttttctccacaatccttcgtttcttgcattccttattttagaatatgacatcacttgtctaaaattcatgaataggaacttcacaaagaattatgacaataaacatataaaaatgttcatctttactagttttgaaaaaagtagaacaaaataaccaaagtgacttttgtacttttctattg

SEQ ID NO: 9342 - DNA, 287 bp, Homo sapiens
ctctctgcttccccttgctcgctcggctatagcccatgggcttctggctgctccttccaccctcagggcacatgcctgccctgcccctgtggctgggcctctctcccaggcatcagcagggctccctcgctccctgtccctacgttgagaaagagaaaagcaggccctgacctcctggagcccgcctggagcccagcggggcttcggtattctccagctgaacctaaatgacttcacaggacatcagcaacagacaaaccacctgggaccacgatggatcacgacac

SEQ ID NO: 9343 - DNA, 127 bp, Homo sapiens
aacctcagggttttttttgtttcattcctaataaagaaataacaaatactgcctcacagactagttgtgataaaataagatatttgatagaaaaatgttttttaaaatgcaaagtattccatatata

SEQ ID NO: 9344 - DNA, 98 bp, Homo sapiens
ccgcagtgcctggcaggttccacttccaattgttaagagtctgaagccagagacagttggttctttcatgctcaaactgggtagcgatggtgcactgc

SEQ ID NO: 9345 - DNA, 170 bp, Homo sapiens
aggtggcatgtgagttttatgaggcaaatctctcagccctgagtttttcaactgtaaaatgagatgtcaatatttactatctttcaggtttgtggcaaatataaaatgagatcatgtgcataaaagtatttgtaaactgaaaaatctcacctcatgtaaaactgttatga

SEQ ID NO: 9346 - DNA, 489 bp, Homo sapiens
ttagttattcacacaaaaacaaccataggactggaactttaaagtgtatgagaatttattcccagtcctaaatggaatatatttttaatgttatcaatacttggggtgaatgaaggtgagttggtggtacccattaaatatcaaggttaggagtggtggctggaaaatcaaccctggtggaagtttaggaataccacggttcaattatgtacatttctgtctgtgagttatggagcaataagacttaaaacaagacttaggctgggcacagtggctgacgcctataatcccaacactttgggagaccgaggtgggcggatcatctgaggtcgggagttcgagaccagcctgatcaacatggagaaaccccgtctctaccaaaaacacaaaatcagctgggcgtggtggcgtatgcctgtaatcccagctgctcagtaaggctgaggcaggagaattgcttgaacctcggatgtggaggttgcggtgagt

SEQ ID NO: 9347 - DNA, 526 bp, Homo sapiens
gagacggggttttgccatgttgcccaagctggtcttgaactgctgagctccagcaattcactcacctcagcctaccaaagagttggtattacaggcgtgagccactatgcctggccatatttttttcccttaatttatatactatagaaatgttggaaatgtcctaaaaaatatgtactcatagttgaggtcaataaacatgtaaagggtagaatcaatctggggaataagttctgatttgctatatgtgaatttaattaaatataagggagttaaaatccaaactagtttacctttgctattttctgagattaaaaaactcatttgtattcacttgagtaatactttaacactgtatatatatatacaaaatgttttttgttgagacagggcctcactgtgttgcccaggccagagtgcaatgatgcaatcatggctcattgcagcttcaacctccctggctcaagcgattctcccgcctcagcctcccagctgggactacaagagtgcatcaccattcctggct

SEQ ID NO: 9348 - DNA, 544 bp, Homo sapiens
ctgtactctgaatcagaataatatactccatcaaggagactgacattggcaccaccttcccagaaatccaggagcgcctttgcatgaggaaaagcagaagggagtaaagtcatgaaacattgtgtgtgtgtttgtataaaactgtatatttttgctcacatataataactatatatttctgctaatttttccttttaaaggctattaagttacttaaaatccattgcctaataaaactgcaattcacctttgtaattcactcatttgtttgctgtcacagggaagatagaaattgagcacgttttcggctgggtgtggtggctcacgcctgtaatcctagcacttggggaggccgaggtgggcggatcacgaggtcaggagatcgagaccatcctggctaacatggtgaaacctcgtctccactaaaaattcaaaaaattaactgggcgaggtggtgggcgcctgtagtcccagctactcgggaggctgaggcaggagaatggcatgaaccccgaaggcagagtttgcagtgagccgagatcga

SEQ ID NO: 9349 - DNA, 218 bp, Homo sapiens
agtatgaattccttaaaaaaaaaaattcattcctcctttctgcgtcataaaataagtaacttttttcccattaaaatcttctgtaatgcttctgaaaaaagcacgcagtttgaaaaacagcaatagtaaatgtgggtctctgatatattttcaaatgctttaaaaaattattaatttattcatcacatgtttatgaattacctacaataacaggcact

SEQ ID NO: 9350 - DNA, 397 bp, Homo sapiens
aaacaaacctgttttccttatttcctaaacaaaattccaaaaaaaacttttttgaagcaaagatcatatgtgttttcaagtatcaagagatctgaagctttttgccaacataaagctaattaaacttcaagctccagtactgggggacacaattatccttactttgccatgtaaatagttaataggatttatttttgtgcttaaagaatatgtattgttgtatgtacttatatttgtccgtgtcagtcttgacccttagaattttgggcacagatggtgtatatctgacttataaccacagaaacaccaaacacaggagctaagaatattactaggggccagctagctccatgtcatcccaacatggcatggctcccactgtgggtaagagagatga

SEQ ID NO: 9351 - DNA, 452 bp, Homo sapiens
gacagaagggtaagaggctcttcagccttgacgttccttcacaagctctctcacctgctgccattaagacatgccttcttccccttccaccatgattataagtttcctgaggcctccccagccatgtggagctgtgagtcagttaaagctcttttctctataaattacccagtcttgggcagtgctttatagcagtgtgagaacagactaatacacagaccaaaagaaaattaatagaaaggggcatggctgtgctgaatggaactgctcgttacagaagaccagacatctatcagaaaaacctgcccaatgccgtagctaattccaaaactaaagattaacccagcaaagccacaatgtacttccaactcttggcagttccaaatgaggtcagcatttaataatggcagcccctaaccctagcaggagcacagcagtaacacagatgaaag

SEQ ID NO: 9352 - DNA, 347 bp, Homo sapiens
acgctttgaaaagagccattcactgattttagtgaaatgaattgttattttgaaaacagttagtgctctggctaatttctcttgttatggcaatctgtgtttggaactccaggactgtgtagatgcagaatgaattgtaagatcctgagaacagcattggctctttctcatgtctgtattttcatattgaaaacagatttgagaacataatagcctgagatgttgatgcacagatataggtggaaatagagagatgacctagagaagcatatttaagctaggctgcagtgatctagagaaaatgtatgtcggctgggctcagtggctcatgcctgtaatcccagcat

SEQ ID NO: 9353 - DNA, 343 bp, Homo sapiens
agatgacttctggtaagtagattctagcacttcttgacactttagtggaaaagcttttggaataattatttattattattcatttacatttttagagacaacctcactctattgcacaggatggagtgcagtgatactgtcatagctcactgtagtcacgaactcctggattcaagtgatcctcctgcctcagccttctgagtaactaaaactacgggcatgcaccaccatgcctgactaattttgtaattttttgtagagatgaggtctcactatgttgcccaggctggtctcaaactcctggcctcaagctatcctcccgctgtgtcttcccaatgtgctg

SEQ ID NO: 9354 - DNA, 429 bp, Homo sapiens
gtgactctgttttctgtggtagtggtagtggggagtgctccaagaactccttgagcctcattagtccctcgttcttatctgagaaggttcctattgcttggtgtattagtccgttttcatgctgctataaagatactacctgaattgggtaatttataaagaaaggaggtttgggccaggcatggtggctcatgcctgtaacccagcactttgggaggctgaggtgggtggatcacctgcagtcaggattttgagaccagcctggccaacatggtgaaaccccgtctctactaaaaatacaaaaattagccgggcatggtggcacgtgcctgtagtcccagctatttgggaggctgagacaggagaatcgcttgaacccgggaggcggaggttgcagtgagccaagatcgtgccactgcactctactct

SEQ ID NO: 9355 - DNA, 564 bp, Homo sapiens
aagtactttataagaattactttattcccatctatgccgggcacagtggctcacgcatgtaatcccaacactttggaaggcagaggtgggtggatcacctgaggtcaggagttttagaccaccctggccaacatggtgagaccacgtttctattaaaaatacaaaaattagctgggcctggtggcaggcgcctttaatcccagctacttggaaggctgaggcaggagaatcagttgaacccaggaggtagaggttgcagtgagctgagatcgtgccactgcactccagcctgggcaacagcaagactccatctcaaaaacaaaaacaaagaaattactttattcccatccaaccaccaccactttaggtagatatcactatttttcattttacaaatgaagcagagaggttaaatttccttgttcaagtccatagagtcaggaaatgaaaaaggaactgaactcaaggagttcataattatttatatacaagtaataaagacaaattcatcgactatggaaatgtactgagtattttgtcttggttacataatggtttttattt

SEQ ID NO: 9356 - DNA, 531 bp, Homo sapiens
attctcctgcctcggcctcccgagtagctgggattacagacatgcaccaccatgcctggctaattttgtatttttagtagaggcaggttttctccatgttggtcaggctggtctcaaactcccaacctcaggtgatccgcccgcctcagcctcccaaagtgcggggattacaggcgtgagccaccatgcccagctagaactttattcctttttatgactgaataatataaattccaatctttgaggatctggaaaagggagaagaatcaggaaaaggcaagtgacaatcaaagagataaggagaaaatcaggagcaaggaatgccctgaaagcgaattgatgaaatgtttgagaagaatagggtatccaccacatgtcccagtgctgcataaaggtcatacagaatgagaagaaaataaaaagccaccaatttctagaattgaagggtaaccataggtggaaatggctgtgaggtagagtctactctcaagtgcttgataagaagccaaggaatagttggccgggcgccgt

SEQ ID NO: 9357 - DNA, 554 bp, Homo sapiens
acaggaaaactatgacctgaattctttgaatcggccaccttatctgcctggttttgaaacggaaacatctttgatctggagtctgggtttgaatgctatgggtgttaaacataaaaaactgaagtccaaggacagcaagggttatcgtaatatctaggtaggtgggacaggcttaattgctttgtattcgtccataaaaattcctttcctgcttgagagggcattgctggtaaattattctgtctcttcctcacttattctcacattccagtttatttcctaagtcataaaaataatacattaaatcctcacataaaccccaaaaggtagatattatttttgtccccattttagagataaaaaattgaaaacaaggccaggtatggtggctcgtgcccgtaatccagcactttgggagtctgaggcagttggatcacttgagatcaggagtttgagaccagcttggccaacatggtgaaacccaatctctactgaaaaaaaaatacaaaaattagctaggtatggtggcaggtgcctgtaattccagctagtcg

SEQ ID NO: 9358 - DNA, 584 bp, Homo sapiens
ggcacgagacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcac

SEQ ID NO: 9359 - DNA, 599 bp, Homo sapiens
ggcacgagggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaggtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagct

SEQ ID NO: 9360 - DNA, 388 bp, Homo sapiens
  misc_feature (1)...(388): n = A,T,C or G
ggcacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctggccccccccctctctttacacacactttctctcctctctctcgctctctctttttttttctctctcccctcgctctctctgtgtgtctctatctcgtgtctctctctgcgtgtccctcacacacactcgcgcgagagatctctctctatatctctcctttgtctgtgtctctctctcgcgcgcccacacatctatatatttttgcgcgcacacgcgagagtgtgtccctctctctctctgcacnnnnnnnnnnnnnnnncacaccctccccc

SEQ ID NO: 9361 - DNA, 630 bp, Homo sapiens
ggcacgaggtcagggaaggctcgccgctgggagaccgccaaagtgacccgagatggagtctgggtggcctgcttattaggggggcacacctgtgcgaggacgggaggggagggagcagcaggactgggcaaagggagaagctgagccacagtgcgagccggacgcacgggccacgttgcgagggcatgacctggggcgaggcagccctggaggagggggcagctgaaggtgtctgctgaccccacacccaacagctcgggtaacaggccttactgtcagagcgatctggttgccacgtctctgtggccctcagagagacatcatgttttcttttttccctgcacctttttgttttgaaaaatgttcagcatacaaacaagttgaacgtaaagtgagcacgcagattcctaggttcagcaggggtgagcagctggccacgtttcatttctctccctctctgtttatatatgtgtatttttcttttttcctccccactcagcccccaccattagctgcagataccgtgatacccccctcccaaatacttcggtatccaactccttaagaacaagaacctcctatattaccaaaatacaatgaccacatcagttcaatgctgttatctatttt

SEQ ID NO: 9362 - DNA, 155 bp, Homo sapiens
tcggcacgaggagagagagagagagagagagagagagagagagagagagagagagagagagagagagagagagagcgcgcgcgcgcctctctctccctctctctctctctctctctctctgtctgtctctctctctctctctctctctctctctc

SEQ ID NO: 9363 - DNA, 396 bp, Homo sapiens
ggcacgaggagagagagagagagagagagagagagagagagagagagagagagagagagagagagagagagagagagagagagagagagagagagagagagagagagagagagagagggagagccccccctctgtgtctctcacacctctccccccccttggggggatcttttatgtgtgtgtgtgtgtatatgtctctctctgcgtgcgcgctctctttttatacgcgtggctcttctctgttttatatcgcgcacacacacactctcctctagaaaaacacacacactctctcttctctctctgtctctctcatatatatacacaccctctcttgtgtgtgtctccactcacacactctcttttctcgagatatatatcttctctcctcttttt

SEQ ID NO: 9364 - DNA, 582 bp, Homo sapiens
ggcacgaggtcgctgctgagcctctttctgtcagcattctggctggggcttctgtacctggtctctcctttggagaatgaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcga

SEQ ID NO: 9365 - DNA, 398 bp, Homo sapiens
ggcacgaggtcgcctttgcccgcgccccccgcctccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgg

SEQ ID NO: 9366 - DNA, 590 bp, Homo sapiens
ggcacgagtagaacagtctgttttcagacagtggtttgaaaagtactttgtgccacaggtacagaagcatttgaaatccaagggacttttagaaaaagcagtgcttcttttagatttccccccagcacgtccaaatgaagaaatgttgagttcagatgatggcagaataattgtgaagtatttgccaccaaatgtcacaagtctgattcaaccaatgagccagggagttctagccactgtaaaaagatactatcgagcaggacttctccagaaatacatggatgaaggaaatgacccaaaaatattttggaagaacttgacagtgttggatgcaatttatgaagtgtcaagagcttggaacatggtaaaatcaagtaccataaccaaagcatggaaaaaacttttccctggcaatgaagagaattcaggtatgaacattgatgaaggagccattttagcagctaatttagcaacagttttacagaacacagaagaatgtgaacatgttgacattgagaatattgatcagtggttcgactctcggagcagtgactcaagctgtcaggtgctgactgacagtgaaagtgctg

SEQ ID NO: 9367 - DNA, 405 bp, Homo sapiens
tggtgaaactccacctctactaaaaatacaaaaattagcagggtgtggtggcatgcacctgtaatcccagctactcgggaggccagggcaggagaattgcttgaatccaggaggtgaagcttgcagtgagccaagattgcaccactgcactccagcctgggcgacagagggagactccatctcaaaaaaaaaaaggccttttctggttttttgggggggggataaaagggggaaatttggtaagggggctttccccggtttgcttttaaaaaagggctttgatgggccgggtgcgggaactaatgccttgaacccaaactttgggaagggccggggggccggctccgaggtcggaaaccaacacctcctgtttacccgggaaaaccccgttttacacaaaaaaaa

SEQ ID NO: 9368 - DNA, 602 bp, Homo sapiens
ttacgttagaataatgtattattttagcccttcatacagcatttctgtgaaaattcattctaagtaactttccactttttattgtacttccttggtttgcattattgcatttattcttgtctaaatgtatcttccacactaatttgcttatatttattatgtctcccttcactagaatgtaaactcaagagagcaggaccttgcatgtcttaatgacatatctaaaatagtatgtggcatgtagtaggtatgtaataaataattttggataaatatataataaaagtgcttaatataagtgtcatatgttccattaagaaacagagcgaaggccgggcacggtggctcatgcctgtaatcccagcactttgggaggcccaggcaggcggatcacgaggtcaggagatcgagaccatcctagttaacacggtgaaaccccgtctctactgaaaatacaaaaaattagccaggcgtggtggcaggcgcctgtagtcccagttactcgggaggttgaggcaggagaatggcgtgaaccagggaggtggaggttgcagtgagccgagatcgcgccactgcactccagcctgggcgacagagagact

SEQ ID NO: 9369 - DNA, 572 bp, Homo sapiens
agtgaagtagatctccacatgctttcagggtttttgttgcccctggtactggagcagagaactattatcaggagtaaattttatgacttcaatctaggttgtgaatttgggtcagccattttaccatttaaagtctccacttcttgttcttaaacaaaacaaaacaaaacaaaaaaacagaataagtcaaagaggagatgagaggtagaggaacttgaaagtgctcacttttaaagctagcttctggacttttcttatttcatcacttgatggttttgtctactttccatgaattctaaattttatggtgggtttggaagaaacatgtcttctatatatgggcagatccaggttttgtggagcttgagccttaagcaatgttggaaaccctctttaaggaaaagaggccgggcgcggtggctcacgcctgtaatcccagcactttgggaggccgagacgggcggatcacgaggtcaggagatcgagaccatcctggctaacacggtgaaaccccgtctctactaaaaatacgaaaattagccgggcatggtggcgcgcgcctgtagtctcag

SEQ ID NO: 9370 - DNA, 536 bp, Homo sapiens
ggcacgagataccatagtcccagctacttgggaggctgaggtgagaggatcgcctgagcccaggagacggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcactt

SEQ ID NO: 9371 - DNA, 234 bp, Homo sapiens
agcatcctaccctgaaacaggcctcatctctggacagtagctatgagatgacacattttctcattgtacaagcaatttgatgtggaaatctttgttacttgaaacaggcattttaacatataaaatgtgattcccactgaccactggcatccccagattctttggtttacctaaaagtatatataagaaaagtgtatgcctgatatctcgttgactccattacaaagaaacatt

SEQ ID NO: 9372 - DNA, 571 bp, Homo sapiens
ggcacgcagagtcactgaccttcatccttcaccctggtcctccatggtgcagcagcatctcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctccggccccttgatttgtgctggacaacaaatggcagcaccaggacctcgcctcatgtggctttgtcttggatcttgcccttctccatcgctgatgtgatacagctctagaatttcgtgaagttgcatgcaaagttgcatgcagcccgtgggtatgactgtctcaggcccccagctcattt

SEQ ID NO: 9373 - DNA, 482 bp, Homo sapiens
cccctcctcaaaaccaactgcgaaaatgtcctctttttatccctgccttaccccatcagctctggcctttttaaaaacatttgttgttctctagtgaagcctctatcaccttctctatctgagaactgaccaatggaaattcataactttatctccagaaatcccagaggcctaaaaaaattaagaggattaatgggaaacttgcaagaaagtgacaacctcgatagaagtgacacatctgatttaggatggaaaaaggttagtcaataaaaatcaggccgggcgcggtggctcacgcctgtaatcccagcactttgggaggccgaggcgggcggatcacgaggtcaggagatcgagaccatcccggctaaaaacggtgaaaccccgtctctactaaaaataccaaaaattagccgggcgtagtggcgggcgcctgtagtcccagctacttgggaggctgaggcaggagaatggcatgaacc

SEQ ID NO: 9374 - DNA, 244 bp, Homo sapiens
  misc_feature 165: n = A,T,C or G
cgacagaagggtacggctgcgagaagacgacagaagggtacggctgcgagaagacgacagaagggtacggctgcgagaagacgacagaagggtacggctgcgagaagacgacagaagggagtctagagctgggccgggcgcggtggctcacgcctgtaatcccancactttggaggccgaggcgggtggatcatgaggtcaggagttcaagaccaatctggccaacatggtgaaaccccatctt

SEQ ID NO: 9375 - DNA, 368 bp, Homo sapiens
  misc_feature 225, 228, 231, 232, 233, 235, 241, 243, 244, 245, 253, 265,271, 272, 302: n = A,T,C or G
ggtggcgcaatctcggctcgctgcaagctccgcctcccgggttcacgccattctcctgcttcagcctcccgagtagctgggactacaggcgcccgccactatgcctggctaattcttttgtatttttaatagagacagggtttcaccgtgttagccaggatggtctcgatctcctgacctcctgatccgcccgcctcggcctcccaaagtggctggaataacagncgngannnancactcncnnncaggcttntgtatatttttntatatnnccaaaatttttaattatactacaaactganaacaaacacaaccattcatctctaattaatatactggttatatcccaaaactacacgccccggccg

SEQ ID NO: 9376 - DNA, 330 bp, Homo sapiens
taggcatagctattttatcatattgaggtactacagctcttgaaagtagcaaagaagtaagaatgacacagttcatatcaaaaattaaagaagtatggatactttcgtggggatcaaaggaaactaaagaagcgcttaaaacaatcacaaatgtcgcagtgtaaaccatcatgaagaactaaataattgtttaatatagaaaccggccgggcgtggtggctcacgcctctaatcccagcactttgggaggctgaggcggacggatcacgaggtcaggagatcgagaccatcctggctagcacagtgaaaccccgtctctactaaaaatac

SEQ ID NO: 9377 - DNA, 601 bp, Homo sapiens
ggcacgaggttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacgtgacttcagggaagcctggacacccgaggcacctggaccagctatgggtagttctgtgggtggacacattctgtgta

SEQ ID NO: 9378 - DNA, 481 bp, Homo sapiens
cctccccagtcgctgggattacaggcgcccaccaccatgtccagctaatttttgttatttttagtagggatggggttttgccatgttggccggtctggtcttgaactcctggcctcaggtgatccacctgcctcaggctcccaaagtgctgggattacaggagtgagccactgcacccagccacgtccctcttttaaagacccttatgattagtgggcctacccaaatgatccaagataatatccctaactcatcagccttaattttttatcttttatttttttgagacagggtcttgctttgtcacccaggctggagtgcagtggtgtgatcatagctcactgcagctttgacttccttggctcaaatgacccttccacctcagcctcccaagtagctggattactgatgtgcatgaccacacctggctttttgttttgttttgtttttgagacagagtctcactctgttgccccaggct

SEQ ID NO: 9379 - DNA, 587 bp, Homo sapiens
ggcacgaggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagac

SEQ ID NO: 9380 - DNA, 563 bp, Homo sapiens
atggcttggtgaccgacagtttctgaccatgtttcactgctacaaagagggttatgctgcattaatctgtcctcatgggtgacggacaggatttcaccccaccacaacctattgaagccccacttctctgacttcagagctgtccagggcccaggctatgaggcagctgtcgagaggtcccacgtacaggttgggagcaccttttctcaagaaacttacaggacagctcctggaactgaggcctacatgacaatggagaattcaggctttgtttcacttcttaaaaaagaagtccagttagatttatgagtatgtccatgaacatgcagaaatataactaatttctgaaagtactgcatacgtgagtgctggttcgtggatgtcagtatgatgccacctgtgtgaggctatcaacattaggaagatgaaaggcactcctgaaatacaagtcagaacgggggcaagtgctggaagagatcaacgaaatgtcacccaccaaccccagagcctggcagaaagcagctcgcccaggagggccagtcgggttctgtgccagcttccct

SEQ ID NO: 9381 - DNA, 642 bp, Homo sapiens
ggcacgaggccgggtgaaatcgtaggacagtgaagatgctgctggaattgtccgaggagcataaggaacacctggccttcctgcctcaagtggacagcgcggtggtcgccgagtttgggcggattgctgtggaattcctgagacacggcgcaaacccaaaaatctacgatttttttgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgcttctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaaccactgtaggagagttgttcgcaacatcaagtagtaccagt

SEQ ID NO: 9382 - DNA, 594 bp, Homo sapiens
tggacgtttctcatagacaaggaactaatttctgtgattactactcctgggattccctaactcagaacacacattcaggtgcatctgccacagggtcattctaagggtgtgcttaagttactgctatcagggcacttgccctacagtagtgtcaggcattttgcctgtatttgcatccactgtgtctcagctaactgcgtgtgtttggccaagttatttagtaataccttgtagggttaccaggagcagctaatgagactgtgtgtaaaacgagccacctctgtggcctggaataaagtggagcttcattggtgtcagttcttttcttttcttttttcttttgagacagtctgttctgtctcaaaaggtctcattctgttgcccaggctggagcgcaatggcatgatctcagctcactgcagcctcaacctcctgggctcaggcaatcctcccacctcagccttctgagcagctgaggtttaggcatgcactaccaagcccagctaatgtttgtatttttttgtagagatgagggtttcaccatgtcgcctaggcgggtctcgaactcctgaactcaagcaataaaatgattgt

SEQ ID NO: 9383 - DNA, 349 bp, Homo sapiens
atgagtgactagctatttacaaaagagcgatttagactcgtgcctcacagaatccaccaaaataaattctacccgtattaaagggttaaggatataaaattaaaccacagaaaattagaagaaaatgaaagacatgttcaatctggatagcagaggattttctaaagctaaaaataacaaatgcgtcattctaattttccttaataggcgtatgttattcttaaaggcatttattattcctattattccttaaaggcatacattattcagaaaaaagcaacagaagatctaacaagggaaataattactgttttagttactttaaaatttaaatccttggccgggcgcc

SEQ ID NO: 9384 - DNA, 113 bp, Homo sapiens
ggcgttacttggattcctctgtgaggaacagcaaatctctgaaaagtgacttctatcgttatgacattgatacaaacacatggatgttactaagtgaggatactgctgctgat

SEQ ID NO: 9385 - DNA, 346 bp, Homo sapiens
attagggttcagtttatcactggacattcaggaggcaagtcaatcttttttatttccttataaaattaactcttcaaaagctgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccatt

SEQ ID NO: 9386 - DNA, 300 bp, Homo sapiens
  misc_feature 8, 15: n = A,T,C or G
cccccgcncgtgcangggacagctgtcctcacaggaacagccctgggacctacaggacttcctggggtttaccctcagatcacccatgaggttagaatcacaaagcccgggagtcaggagacacagggcagctggagggaggtctttactgaggctactgaggcacagcagccccgtctagaggcctccctgagaggcacttcctgaggagtctggtggattttgagctgctttttaaacaaccttctccttagcatagacactgacactgaagggaaagaaagcaaatggtctgttctt

SEQ ID NO: 9387 - DNA, 340 bp, Homo sapiens
aaatgagataacaagagtgctttacttcatttgattttggggaagatgaaataatttatgccaagagcttatagcatagtgcttggcacagagtactgttcaatactgatgtttaatcaatgctgctgctatcattattatttttggaaaaaagggaaacaaatatggaacttaaatagttcataagggcatagcctctagcagcctctacattccaggtagggggcagtgaaaaagagcaggtggaggtcaggagttcaagaccagcctggccaatatggtgataccctgtctctactaaaaatacaaaaattagttgggcgtggtggtgggtgcctat

SEQ ID NO: 9388 - DNA, 341 bp, Homo sapiens
  misc_feature 118, 130, 140, 145, 147, 150, 155, 157, 181, 188, 209, 226,231, 236, 246, 255, 274, 284, 308, 316, 319, 320, 322: n = A,T,C or G
ggaggctgaggcatgaggtttgcttgaacctgggagatggaggttgcagtgagccaagatggtgccattacactccagcctgggtgacagagcaagactccatctcaaaaaaaaaaanacaccaaagatnttattaatcnctgancnctnttttntntcaattataagtaattgaaaattntaatcancctcctatttaattaattaanaattgatttaatgattnagttnaaaangttaaattcnttttaaaanaacccattacatgttaacncaaatagcangtttttattttattttattttganacaaagtntcnntntgttgcccaggctggagtg

SEQ ID NO: 9389 - DNA, 449 bp, Homo sapiens
acttttgacttcctggggtccttcttcagttaaaaaaaaaaattaaaaaattaggccgggcgtgggggcacatgcctgtgatccacccacctcagcctcccaaagggctgggattacaggtgtgagccactgtgcccggccttgactaccatattttaaatttactggaggacttttttgttctcttcttttttctttttttaatagcatcccgctcttatttcaaaataaaaaatttttaaggtatgttgagtaaaaatctatagagcaatgaaaatgcaagaccaatagctatgggcaccaaatgggcaatcttcttatcataatgttgaggggaaaaagccaggtccaccaaacacatgctgctcatttatccaaagtttggacacaggcaaaacaaaactagttggatcgtgatgggaaacattagagaaatgcaaagacatgac

SEQ ID NO: 9390 - DNA, 613 bp, Homo sapiens
aatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaacagaaaaatattcattaactcggggatgcattaataaagtttttaaattcaaaatgtatagaaaaatcaagcttagtaatactttaatattattctaccaatgtattttttttaattaagacttctgtatgcagcagggcatggtggcacacctgtagtcccagctactagggaggctgaggcaggaggattacttgagcccaggaattcaagcctgggcaacat

SEQ ID NO: 9391 - DNA, 256 bp, Homo sapiens
agaccagggagtaggctgctgggctggtccaggcaagaggtaacagtggacaggaccaggcggagtgagaagaggtcagatttggaattattgtgatcagcagacagctcttacctggggtgtgagggaaagaggagccccagaggactcccctgtttttgcaactggaaagcaatggtcagccatggcagggttttgtcctggcatcaagacaagcgagcccttggctgggcacaatggctcatgcctgtaattc

SEQ ID NO: 9392 - DNA, 568 bp, Homo sapiens
gctgtgatcggtatcctacagccttaccctcgtgtcctggatcttttccttccatttcctgtgtacagcctttttggggacactgccgttaccccactctagctagcatagctctgtctgtaggtgctccataaaggtgataggactgaccacaccgtcacctttcccggaaacccaagagggagcgttccacagagggagcgtgtagtggggggaactgttttataaattaatccgtttattgaaaggttcacaaggacaaagaggcaacagcaagagtcaggcacagaaataaaggacgcagaagtagaagtgcgccttggacctggaggactcttccagagtgtttatcacttggtgacctggtaggagggctgcgagggctctgttcaccctcagcaagggccacgtgtggggaggattccatggaagtctctgctgagaggggatatgataaccaccagagcaccagtgcttcttacctgtacttaccaagtggcaggctgtgtgccaactcctttatacacgttgtctcacctaaaccttagaatcccttttttatagctga

SEQ ID NO: 9393 - DNA, 592 bp, Homo sapiens
ggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaagtcgtggctcttattggtgtagctacagctgcagataccttagtgacaaagtttaatcagcttcctg

SEQ ID NO: 9394 - DNA, 63 bp, Homo sapiens
gagccttctcaatagcacagtccctgtcccttaaatataggttgtgtgacttctatatatgca

SEQ ID NO: 9395 - DNA, 624 bp, Homo sapiens
ttttagtgtagtagtcaaagcattaatttctcacattgcaatttccttcaaagacataaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgacctcggttcactgcaacctccacctcccaggttcaagcgattctcctgtctcagccccccaagtagctaggactacaggtgcacaccaccatgcctggctaatttttgtatttttagtacagtcagagtttcaccctgttgtccaggccggactcgaactcctgacctcaggtgatccacccaccatggcctcccaaagtgctgggattacaggcataagccaccgcacccagcctgatattgcactcttggattttgaacactgaatatctttttgaaagattacacctctttacctcttcgtgcttcagaaattattttccttcaagtgttctaagaggctaatgaagaatgaagtcatgttttatcacttttgtccttaaagatttcagacatgctgaaactg

SEQ ID NO: 9396 - DNA, 531 bp, Homo sapiens
tgcagtggtgcgatcttggctcactgcatcctctgcctcccaggtttaagcaattctctgcctcagcctcctgagtagctgggactacaggcgcccaccaccacacccagctcatttttttttgtatttttagtagagatggggtttcaccatcttggccaggctgatcttgaactcctgacctcatgatccacctgcctcagcctcccaaagtgctgggattacaggcatgagccaccccgcccagcccggccgtctctttttctacagtagaatttcttttctaattttttgatctcacaagaggatgtcctggaattcagtagaatttctaacattgtcactggttttcctgaaagtgagatttatctcattagacatgtttggtataaatacctcctctgtttgctctactcccaaccaggagggatggttgcttttatacagaccgcattctggaaccttctttacagatacccagcccttcacgggcatcccatcagtaggcgattgctatagtttgaacttgca

SEQ ID NO: 9397 - DNA, 647 bp, Homo sapiens
tgtgctacattataatacctgtcaaggagcacttggaaagtgagaataaatcattgcgagcacattactcagtcttggttagtcagggaaggttgcacagaggagaaatctaaaccttggcacttctgaagtcacctttctgaaaacattctggtaactgttagatcccttgttgtagctattcatatgttctgtgtggttaaacaaggttcacagtgggccacctggcctttggaacttggctgaagaggctgccttcagttcatcctccccacccccgttttcaaaacatgggtttccatgtgttcgttgtaaattaggaaacataaccatgttttgaggcttcatagaaaacaaacgtctggggtcacacaggttaaaggaggaaccaaattcagcactatcactgttctattcggcaggcaattctggggccttcctgtgtcccaggttctgtactagttgtttcaggactttgggataaacacaaactatccctgccctcagggggattaaggtcaggtgtacaaatgactctaatgcgaggcaaggctggattcagtgctggaagaggagggcatacctaacgctacgggaattcaaagaggaaatgatcagaatgaggagggagagatgggtcattccgg

SEQ ID NO: 9398 - DNA, 648 bp, Homo sapiens
actttctgctttgccccctccctacctctatgctgatgaagagccagccatgcctccagcccttcctgaggccaccacatgatcttgcttattttcccattccaggaggtcacctgcagggctcctcccacctagccacaatggctagtcccgctgcctccacagtggccctgcagccccatcccagacccactgcacggggtcacaagcttgtgcagggtggacagagcagtagctcatggcagacattccttctgttcatctgttgcagggaaaatggggtgaggcatgggaggggttcccagaatcccagaaaggcagaaggagttgagatctgagacagagtaggctttggagactccctccacagaccactctcccaggggctaggttaatgggcctgctttgggaagctggggcaggtgaatcacctgaggtcaggagttcgagaccagcctggccaacatggtgaaacctcatctctactaaaatacaaaaattagccaggtgtggctgcacatgcctgtagtcccagccactcgggaggctgaggcacaagaatcacttgaacccaggaggtggaagttgcagtgagccaagatcacgtcactacactccagcctgggtgacagagtgagactctgtctc

SEQ ID NO: 9399 - DNA, 308 bp, Homo sapiens
cctatcacacccattcataaagatcttgcgtaggtgatttgggtttaccatttttgtctaaacttttcctcatgtgagttctggataatggactccgatttttttaaaaatggtaaaactaattgaacatatcagtcatttgtagttggagaaaaaattgacttgctttctatatgttaagtctagaccattttgccctctttgtaaaatgtgatttgtttttgtatatgtttagtaattttatgagctatttataacttactgtgaatgatcagagaacagggttcttttttttttttttaaatggt

SEQ ID NO: 9400 - DNA, 456 bp, Homo sapiens
taaacagcatcatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaatt

SEQ ID NO: 9401 - DNA, 222 bp, Homo sapiens
ggtaagtgaacgctttacttcttcatctattagaaaattattctctcaccagggtgcggtggctcactcctgtaatcccagctcactcctgtactttgggaggccgatgcgggcagatcatgaagtcaggagttcgagaccagcctgaccaacatggtgaatccccgtctctactaaaaatacaaaaattatccgggtgtggtggcacacacctgtaatccc

SEQ ID NO: 9402 - DNA, 586 bp, Homo sapiens
atatgactataaaatctatcttcatctgtagggaaggtaatgaattagcataaatgccttcataatccagtctctctccctcccctcttttctaataaaaatgcagagagaacactgtgaagctcaagctgcctctaaagaaagtagagatttacagaacataacctcacaagatttgttgatgaattatgaaggaaggacatttattttgagaatcatgagcattataatatttattgaggattagaattttgttatgtggaggtgctactacctcctcatgagccacttctgcactcaatctcagtaagaagaaaatgattaatttgtaaaatattaaattatcatgattttttcacttttctgtcggttttttctgttgatgtcaggtagcttatctttagtctttatgattaaaaaatgggagaaagatatcatattaaaaatgcagaggctgggcacggtgactcacacgtgtaatcccagctttgggaggccgaggtgggcagatcacctgaggtcaggagttcaagaccagcctggccaacacagcctaacaccatctctactaaaaatacaaaaatta

SEQ ID NO: 9403 - DNA, 528 bp, Homo sapiens
  misc_feature 410: n = A,T,C or G
atatttttaaaaggacaaatttcaggacactttccatctgagttcataagaaggtcctcttgagtatccttcaaagttaaaaccctctccccttcagattaatgaaaatattaggatgcatagaacacaatgggcactggtgatatggcccatggtagctgaattagattgagtataaatgaagtcttcacataatagcaaagaggccaacagaagaaaggccagaaagccacttgaaactcatgtccatggaagaccaaatgaagttgatttaactgttcccttagaaagatattatcccattgcttagccctcaaagtgttcatactgctactttccttctttatatcaccagttctgggagcaaacctcctgaaagaatggaagtatagactgtaaacacaagactngtgggtacagcaaaggggctctgatgctctagttgtttgtgtctagatactgtcaaatgtcccttgtgatgcacaattgcccttagcggagaaccattaaccaaaataaatgaaataa

SEQ ID NO: 9404 - DNA, 638 bp, Homo sapiens
attttaacagcaaatatctttctttcttagtgatttaaatcagttgactataccttgcttaaatccagtttctcacaaaatagaataaacagcaaatggttttatgattgtagcaaatgattcttaaaaattttccctttgataaatattgtttctacctatgtagacataatgtggcgatttggagagtgacattagcttaggatcaaataggattccatgactgagaacagaaggaagattctttctttcttttcttttttcttttcttttcttttcttttcctttctttcatggagttttacttttgttgcccaggctggagtgcagtgacatgatctcggctcactgcaacctccacctccaaggttcaagcgattctcctgcctcagcctcccaagtagctgggatttcaggtgcccgccaccatgcccggctatctttttgtatttttagtagagacagggtttcaacatattggccagactggtctcaaactcctgacctcaggtgatccgcctgcctcagcctcccgaagtgctgattacaggcatgagacactatgcccggacaaggaagatgttttcttaagtttcacactggcacttgaccttttatgaattcacggagtctcgggt

SEQ ID NO: 9405 - DNA, 328 bp, Homo sapiens
acactttgaccactttggcagtaagaaaatctatttgcttactccaatcttcattaaatttatttaaccattgaatttttttgctccctaccccctacaaaacgcctattaaacgcttcacagttgacttatgctaataggcaataagggtgtgacccaggagaggctatatacatatgggcacatacattacatattcagaaaagcattcagaagaaaacgctcatagaattttagaaattataattccttggctgggcacggtagctcatgcctgtaatctcagcactttgggaggccgaggtgggctgaccatttgaggtcagga

SEQ ID NO: 9406 - DNA, 122 bp, Homo sapiens
caaatgaaaagctgatggctcagagaagttaaatgacttgcccaaggtgactgagccagtaggccacagacaggctccaaatcccagtctggaccgattggatgggcattcctgggtgggcc

SEQ ID NO: 9407 - DNA, 246 bp, Homo sapiens
ccctctgggaggctgaggaggtaggattccttgagcccagcagtttgagaccagcctgggaaacatagggagacgctgtctctataaaaaataataattacaatttaaaaaaaattgatgaagataggtgaaggttatatgacctttcactacactattcttgaaatttctctgaaggtttgaaatttatcaaaataaaaaaattgagaaaaaattttcaaactgccacagtcaataattgaattc

SEQ ID NO: 9408 - DNA, 580 bp, Homo sapiens
ggcacgagggctgacggataaaatgaggaagccaacttcactgtatcctcaatgcatggagacatgccccacaaagagcgggagtccatcatgaacgtattccggtcgggcgccagccgagtgcttatttctacagatgtctgggccagggggttggatgtccctcatgtgtccctcatcattaactatgatctccctaataacagaaaattgtacatacacagaattgggagatcaagtcgatacggccggaagggtgtggccattaactttgtaaagaatgacgacatccgcatcctcagatatatcgagcagtactattccactcaaattgatgagatgccgatgaacgttgctgatcttatctgaagcaacagatcagtgggatgaaggatactgttcacctgctgtgtactcctgtttggaagtatttacatccagattctacttaatggggtttatatggactttcttctcataaatggcctgccgtctcccttcctttgaagaggatatggggattctgctctcttttcttatttacatgtaaataatacattgttctaagactttttcatta

SEQ ID NO: 9409 - DNA, 482 bp, Homo sapiens
ggcacgagccatcttcaagagatgactttacagagtttggaaagttactaaaagataaaattacacaatatgaaaagtcactatattatgccagttttttggaagtcttaattcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctgggtatttaaccccttgacactt

SEQ ID NO: 9410 - DNA, 103 bp, Homo sapiens
ccttcctccattatcagtactttcaggtgtctcactacagattagaatggcccactgctgtcttatctgctgagatctttgctatttttagttcattaaacac

SEQ ID NO: 9411 - DNA, 579 bp, Homo sapiens
gctcttaggatacaaaacaagacagggaaattttatctggtattggtttcagggacccgtagcaaacttggtaactgaccagctgccaggcttaaaatgcgagcttataggagccgtaaacccacgttctatccagtgatacctctctttccattatagagtgacacagaaagacaaattcttagcacaaattgcaccagatatgctacattctaaggctagtctcacaaatcctctttttttctattaatcaaacttttgcagaggagacaaacagtgacgtttaacattccccctaccctcaccctccaccacacatacacacacagagagagagagagagagagggagagagaccagaagcttgactagtaagaatttcttaggccaggcacggtggctcatgcctgtaatcccagcactttgggaggcctaggtgcgtggatcagtttgagaccagcctgaccaacacggagaaaccctgtctctactaaaaatacaaaattagctgggtgtggtggcacatgcctgtaatcccagctactcgggaggctgaggcaggagaatcacttgaaccca

SEQ ID NO: 9412 - DNA, 563 bp, Homo sapiens
cacaatttaggatcgtgccagatcacccaacaaaagatggctaatacgctgaaagcaggtctcttggcaaaaacaggagtatgaagaatgtggacgtacatttccaattgctcgtgggaggccaggtgcagtggctcacgcctgtcatcccagcactttgagaggccgaggcgggtggattacttgaggtcaggagttcgagaccagcctggcccacacagtgaaacctgtttctactaaaaatataaaaagtagccgggtgtggtgacgcctgcctatagtcccagctactcaggaggctgagacaggagaatggcttgagctcaggaggcagaggttgcagtgagctgagattgagccactgcactccagcctggatgacagagtaaaactctgtcacaaaaaaaaaataaaaaataaaaaaaaacacaagaaaacaaaaaaaaacccaaattgcttgtaagagacccctgccagcatagaaacatttacccatctaatgattattcaagacctgggaggaaatgaaggtgttttatttgcataccaaattcaattaacta

SEQ ID NO: 9413 - DNA, 599 bp, Homo sapiens
taaagctagaagatttatcacgcagcaagttcaacctcaggaattccatataagtccacaagcgcatgtgtctaaaaactgttgagtaagtaaattcaatgatgaaaactgtaatttatatcaaggatgagaaatactctctttgtaggtctattgtcaatgactaatatatgaagaattaatgcagttgatcatctaaataatgctacacatgtctgtttccattggcctgtggacaagaacatgtgtcagtaaaaaaaagagttttgaaataaatctcagatattatgattgtttcattttctctaataaaatgtgaacatttattcattcttggaaaataattttgaatagaggtatattcaggtatatgtgttatattcctttgttaactttataggcattagtttcattaattaaatataatgtggctttggtggaatgaaaaaacactagcctgaagctgaactggtcacttttcagttttgtgtttggtgggtgtggacagacatgatgtaattctttggagaattgagacaacttgggagatttacagggcacatgtgattgtatttccattagtgaaattgtcacacatt

SEQ ID NO: 9414 - DNA, 103 bp, Homo sapiens
gcaagttgctttttccatctcagcttcagttcgcccatctggaaaatggcaataataccaagcatctggcagcctgaggatgaaataaaaatcacagaacctt

SEQ ID NO: 9415 - DNA, 516 bp, Homo sapiens
taatttctgtgcccctttactcaaaaatagtacaagacaaagaaaatgaaaacagaaacaaactccaaggtccatgaaaccagaaactaatcctgaaccatgctaacaaaatagaaagcttatcaagtgattataaaccactctgcatataagcagcatataagtccaaatgcctgcagagagtcctgtgggactcagaaaagcacagggactagagcaagcttgttcaacctgaggcctgtgggccacatgtggcccaggacagctttcaatgtggtccaacacaaattcataaactttcttaaaacattacaaggttgggcgcagtggctcacacctgtcatccctgcactttgggaggccaaggcgggcggatcacaagaggtcaggagtttgagaccagcctggccaacatggtaaaaacccgtctctactaaaaatacaaaaattagccgggcgtggtggcacacacctgtggtcccagctactcaggaggctgaagcacaagaatcgctt

SEQ ID NO: 9416 - DNA, 300 bp, Homo sapiens
aattccgttgctgtcgcatcagccctgctttctcccgctccgtgactttgcatcagttgtcatgaggatgattaaataatttagcacttagccccctgctgtactccttggcctggatcatgaccacaccgaaggagtgcccaccagcaagagacctggagacatccccaattcctgcaagcagaatctgggatgaacagtctgcatgcctctcgccacctgtcccagggattccctgttccacaagacacttgggatctgcttgtcatgcatcatgcgtaactaatagtgcagaggaat

SEQ ID NO: 9417 - DNA, 145 bp, Homo sapiens
taaagatgaggtttcgccatgttgcccaggtgggtttcgaactcctgagctcaaacaatgcactcacctcggcctcccaaagtgctgggattacaggtgtgagccaccggacccagcctacacttttttgaggacatgtatgtcc

SEQ ID NO: 9418 - DNA, 327 bp, Homo sapiens
ctgggtgacaaagtcgcaaggttgtgtctcttacctgcccacaggtgcacgtcgtcagccccaccgcctcactgcagcccccaaggttaccgccagccgccgaggggtgggaacggcagggtgatgatatcaacagccaagaaccccctgggcttgtccactgctcaggccgtcccagcccccggggaagcaggtccaccactaggcccattcgacagatagcagcacaatcaccgtcaccacgactggagaatgacatgtcccagcacctagtgccaggccctcttccaagggcttgcatttgcttatccatttaacccccagcag

SEQ ID NO: 9419 - DNA, 590 bp, Homo sapiens
tgggcacagacgtgagtgagtgtgtgggatgaggaagaaatgtgtggaagttcttgtgtgatggagcaaaagttcttaagtgcagcaggtgaatttgctgacattgcgttgatttgttgggatagggattgaggaaagttggtagaagtttagaataatcactgagggaaaaggacagggtttgatggggagactagagagaaacatgaagggttgcctgtccaggaaagttggtgtccaccaaagttggagtctatgaatatctaaagtcagatattcttgtgatcgtgatatttattcagcttttgttgagcttagtagtttagaagtacaggaggtggatgattccattgcttaaaggtttggttttataaaagttctgtcagaaggatgaaagagcaagagacttgaggttaaaatgttccaagagtgtttgaagaaatgaactatgttattctaaagatgtccatagaggctgggggcactgtggctcactcatcccggcaccttgggagcccaaggcaggaggatcccttgagcccaggagttcaagaccagcctgggcaacatgatgaaatcctgccactacg

SEQ ID NO: 9420 - DNA, 481 bp, Homo sapiens
ggccttctgaagcagagggaagcctatcagagtaagctcaggtgggcctggtcagcctcgccgagctctcatttccactctgcccacagccacagagggaatgggttgcctggagaggtagcgagtgctgcatcagtgcaggtattctcgcacagattcgacaactgcgtatcagcctgtaggtgagggaatagttaggcttgatcatccagaaagttccttttgaccctaaaagtctgattcttgtgattctagcctttggcaaaccacagataaccagtctctcctcctatagtatagggttcttattacgattattgaccttgtgatgacaagggtcacaaatccaggaggctgtgaagcccctgaaattattacttttttcttccttttttttttttttttgggttttttaaaacctaaatctggaaaagaacccccttaaatttttttcccaatttgggggggttgccttttggcc

SEQ ID NO: 9421 - DNA, 460 bp, Homo sapiens
gtttttaatggaacaaaactattttgggcatctttctatgtcaaatacacaaacttacttcattctcttagtagcaacacaccattccactgcgttcttaaatatatcaacgttctctttaactctgtaaaagcttcattaaaattttaattataattgacttaaattgataaattaatataggggagaatttacactttaaaaatacttagtatttctttttttttttaaatttttttaagacaaattctcactctgtcatccaggctagagtgcaatggcacaatctcggctcactgcaacctctgcctcctgggtttgagtgattctcccacctcagcctcccgagtagctgggactacaggcacatgccaccacgcctggctaattgtttgtaaaaatatttatttttcctatcaaggaacatggcatatctttccatttatttaagtcttctctt

SEQ ID NO: 9422 - DNA, 614 bp, Homo sapiens
ggttgaaagtaaggatttaatgtttatttttccaaatggatagacacttgtcaacaatcctttattacacaacccatcttttgcccactgtttggaaatgcatgcttaagtttgtatataaattagtttgtttcttgacttattattttgtttcactaattaatctatttctaagtgtattcatttttgattgctgctgtaacaaattgtcaatagctaagacaacactgggcccggtggctcacacctgtattcccagcactttgggaggctgagacgggcagatcgcttgaggtcaggagtttgaaaccagcctggccaacatggcgaaaccctgtctctactaaaaatacaaaaattagccggtgtagtggcgtgcacctgatatcccagctactcgggaagctgagacaggagaaccgcttgaacacggtagacagagattgcagtgagccgaggtcaccccactgccctccagcttggacgacaaaagtgagactccatctcaaaaaatatttatatagctaagacaatttttgaaaaagaagaataaggtgggaggaattgctctaccatatttcaatacttcttatatagctacaggaatcaagact

SEQ ID NO: 9423 - DNA, 605 bp, Homo sapiens
gtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccacataaaatagtatatgaggtcacctctgattcctatgtaaagaagattcctcctcccttccctcattcattgttctccacactctactccacacctcccctcaccctgcaatccaacttatcaaaagtttaattttccctttccaaaagcaatgtacttgaaattcctattcttagttatgtgcattttggtttcctctttgattttcctttttttccaggtttcctgttgataccaacatgaatctcaagggcttccctttgcttcttttggaaaaaaataaagaaaagagactgatttagagcctatagggtggaaaatcacagccaggaaaaggcaggcatagcatgcagcagttcagagacagggctcacccgcccatctcttccatcagccacctccctggtagggcatcccttggaacagaagccagcaatggtcctgcaggga

SEQ ID NO: 9424 - DNA, 578 bp, Homo sapiens
ttactaaattaaggattattatagcagatacaattctatatcaacatgtccctagagaaacagtggaagtaactatagcagaaaattttaaagcactgtaaattatactgtgccagttatgaagaatttattttcaattgtataatacataaatgatttaacaaaatatatcatttaattgttttaatttttgttatccctaaattattataaaaaatcttccaatcttaataatagaattttgtctttttaaattcaaaatcctattttaagcaatttggaaatctgtaaaagaagcattcactaaatatgctctatgctttctacttgtaaatgcattgcttgtaaaatattgctcattttagttgctgatctctagtgactcacacttgtccttctttgtaggagttcctatgtagtccagatttactgagtgcgaaaagggagcagctacattctgttctcatcaacaagctaacttagtataggtggctaatgttcagactatagcatttcagagtgagggaagatcttcagagaagaggccagctggaaccatttgttgcttatcacacatc

SEQ ID NO: 9425 - DNA, 636 bp, Homo sapiens
gaattatttgcatctcatcactggaagtcccattgaacagcactactctggtttttgcccttgcttcacatagcgtggtgcagaaaatagcaattctgaatcacttattagaactggagtcttagatctcacccagaccaactgaatcggaatctgcgttatatataacaagattgccagggcactcagtgcatgttaggatttgagaagcgccgctgcatagtacacatccaccatgtttagtaacccagtccttcagtgatggacacctaggttcccttcactttgagcgtgccacttatgtatctatacaagactcctcttgaccattcacacaggagtgggaccaaggggcctaaaggcctattcttaatcaatttcaccgaatactggcaagtttttgtctaacaaagaagggttcgaccaggtgcggtggctcacgcctgtaatcccagcactttgggaggccaaggcgggcagatcatgaggtcaggagaccgagaccatcctggctaacacggtgaaaccccgtctctactaaaaatacaaaaaattagccgggtgtggtggtgggtgcctgtagtcccagctactcaggaggctgaggcaggagaattgcttgaacccgggaggctg

SEQ ID NO: 9426 - DNA, 215 bp, Homo sapiens
ttgtaagttggtttcaggctctgttgaataaaagtgtttgaatctttttttctctattaatatttcttggtagtacatatggtcaaatgtttattaaagaggaaaaaactggtaagctttaaaatgctgttaaaagttttggaaacttccttgacagaaatttcatttttggtgttgttgaaggttaacttaaaaattatgtgtgtgtgtgtgtg

SEQ ID NO: 9427 - DNA, 565 bp, Homo sapiens
ggttgagtggtcttgggcaagacactgtccctctctgagcctcactttccccttctgtggaataaagggactggaccatcctaactcatgttttttctacagagaggacctctgtctacagccagacttgataatgaattccccaggagtccaacctctggccctaaaaagggggttcaaggaaatcctcataccccacctctttcaacagcactggccaatggcccccatgctgcaggtaaaaacatggccaaagatatggatgaaacaaaatccaatccagccaggcacggtggctcacgcctgtaatcccagcactttgggaggccgagacgggcggatcacgaagtcaggagatcgagaccatcctggctaacacggtgaaaccccgtccctactaaaaatacaaaaaaaatagccgggcatggtggtgggcgcctggagtcccagctactcgggaggctgaggcaggagaatagtgtgaacctgggaggcggagtttgcagtgagccgagattgcgccactgtactccagcctgggcgacagagcgagactccgtctcat

SEQ ID NO: 9428 - DNA, 554 bp, Homo sapiens
  misc_feature 384: n = A,T,C or G
tttggagcaagtaatttttctgctctgaatctgtttccttatctgtaaaatgaagccgatatctacctcttaggtttactgtgaggataaatggaaatgttgccagtgaagcaacctgatttagtggctggtacatcataggtgatcatttcattgatccttaatgcagccatttaacaaatgtctatgggccagccatttgccaataagcaagcatctggctcccctacatgttacgttctagtgggaaaaatgggcaacagaggtataaatacaaaataaatattttgtatgatgacaaatattttaataacatgtgttctaaaagtaaaacaggttagtagggggaaaaagagtgctacagaagatgaccaatctggcggngcatgttagctcacatctgtaatcccagccctttgggaggctgaggcgagtggatcacctgaggtcaggaatttgagaccagcctggccaacatggtaaaatcccgtctacactaaaaatacaaaaattagccgggcgtggtggctcatgcctgtagtcccagctactcg

SEQ ID NO: 9429 - DNA, 507 bp, Homo sapiens
  misc_feature 359: n = A,T,C or G
gaggtcaagagttcaagaccagcctggccaacatggcaaaaccctgtctctactaaaaaatacaaaaattagccaggtgtggtggtgggcgcctgtagtcccagctacttgggaggctgaggcaggagaactgcttgaacacaggaggcaaaggttgcagtgacctgagatcacaccactgcactccagcctgggcacagagtgagactctatctcaaagaaacaaaaaagataacctagtttttactgtttcttttgcattatatgttagatttttcatgtacatttatgggtttgttgtagtcttaaatttgatttttatataattaaagatctatatgattgtatgcagccctcanaggggagctttgttccaaaagtttatctataaatcatagtttgtggactgctgtagagaaactactataaattgtgattgaataggtttccagtcaccccacaacatctatttcatttcacaatgtggatgaatttagtttatacttc

SEQ ID NO: 9430 - DNA, 464 bp, Homo sapiens
cttaggttagacctgcactttctaatataatagccactagtcgcatgtggctactgagcacctaagaagtggctagtcttacttaacatgtgctgcaaatgtaaaatacaaactggatttttgaagactttgtgagaaaaaagttatgctgattccatcttgaaattatattttgggtatattgagttaaatgaattattaaaatgaattttacctatctttttacatttctaaatgtggttacaattttaaaatcacacattaggctttcatgtgtggttcccatgtttctattagatagtactgctacagtttgcaggaaatctaggggatgtggaaataagtgaaacaattgcttcatttataaagtgagataggggtctcactatattgtccaggctgggtctcaactgctggattcaagtgatcctcccaactcagcctcccaaaatgctgggatcaca

SEQ ID NO: 9431 - DNA, 327 bp, Homo sapiens
ctcagcctcccaagttgctgggattacaggcatgtgccaccgcgcctggctaattttgtatttttagtagagacggggtttctccatgttggccaggctggtctcaaactcccgacctcaggttatcctcccgcctcagcctcccaaagtgctgagattataggcgtgagccaccgcacccggctaccttgacattttctaacctagagtcaccttaaccactgtcgtctccctctggaatcccctctagaagatccccttaatttataccactctgtctcctggcattggccacattcctgtcttcagatatcccagggactcacc

SEQ ID NO: 9432 - DNA, 361 bp, Homo sapiens
caaagattaaagacccatgggccagaaggtaccacagcttttatcttccctttaagaaatatttgatccaagcacttatccttctttaagtcagttaattagagctcttttttttaatagacattacacactcaatacatatataactacacagacaggcagaagatccagtagctataagattttttgtttgccatctcctaattggattattggcctctgggtggagccctttaagagcaagggtaggaaagcatgtagtttctagggcctaataaacaggtatagctgacaaagacagactttgacagggatccatctgcctgtaatttctggggctccatgaggaaaacaggtctct

SEQ ID NO: 9433 - DNA, 527 bp, Homo sapiens
ggctgggagaggggcacccgcgcacgggagcagccggtgggaactcaggggcgactcagagggatcagcctgcaggtcacagcccgggctgtggtcccatgggctctgtgctgcctgtgtgcttgcgaagttaattacagccacacacaaactcactgcaaattgttcccagttagaactgcaaattcactggaacaaggagtgctaattacattccacttgttcccactgcctcttgttaatattccaacagctgcttcagcaagataatgatggctccagccgaaatgattgaacagatagatttaaaaatcagtactggctgggcgcggtggctcacccctgtaaccccagcactttgggaggccgaggtgggtggatcacctgaggtcaggagttcaaggccagcctagccaacatgatgaaaccccatctctactaaaatatacaaaaattagctgggcgtggtggcgttcgcctgtagtcccagctactcgggaggctgaggcaggggaatcacttgaacc

SEQ ID NO: 9434 - DNA, 472 bp, Homo sapiens
caacggcacctacctggtcagcttcactctgttctgggagggccaggtctctctgtctctgctgctcatccaccccagtgaaggggtgtcagctctctggagtgcaaggaaccaaggctatgacagggtgatcttcactggccagtttgtcaatggcacttcccaagtccactctgaatgtggcctgatcctaaacacaaatgctgaattgtgccagtacctggacaacagagaccaagaaggcttctactgtgtgaggcctcaacacatgccctgtgctgcactcactcacatgtattctaagaacaagaaagtttcttatcttagcaaacaagaaaagagcctctttgaaaggtcaaatgtgggtgtagagattatggaaaaattcaatacaattagtgtctccaaatgcaacaaagaaacagttgcaatgaaagagaaatgcaagtttggaatgacatccacaatcccc

SEQ ID NO: 9435 - DNA, 569 bp, Homo sapiens
atgagatcttttggcggtctaatagctattaaaatttcaaagtgatgatcataaatgatgttttgagataatctataacaataataatgtggcatgaaaatatctgatttctatgggtgacaacttcacagattctgccaatcctaagagatgctaaatttttgttaaaagttcatgaaaatgagatgcaattcaagttgacagaaccctgtgaattctatccatggatccctttaggatctgtgcattacaggtaaagaacacttcctttacagcattgtaaaccagtgcacgaatgctcattagacatgtataatacaataaagttctgctggctaagagcactctagaacattggaagcagggagatgagggtaggagaattgcataaacagcatagtctctggagccagattttctgggttcaaattccagctccacctcttactatttttgtgatcttgaacaagtgacttaacctctcaacactatttcttcaacttttaaatggcaataatagggccgggcatggtggttcatgcctgtaattccaaggaggggaatttgga

SEQ ID NO: 9436 - DNA, 491 bp, Homo sapiens
aaactggtacaccccttctggagggcaacctgacaattataccaaacatatgtatatccttcgagccagcaatttcatttggagatattcactcaaaaaagataaatataacgctgcatatcagcattatgtagcataaacctggctgtatatcataagtacctaaataatctcactcatcactattaataagctaaaggttttactttgaacaaactgatagagggaattgtttagccttcagaaatttttaattaaatcatatggaaatgaaagtttgagaataaaaggaaagcagcgtaatagctaaatggagcaaaaggatcattaaaaatttttctcaaaggtagaggaaatcaaatttgataaagggaataaaaatagagtcagtgaaaaggaaaatactcaaaatgataggaagaaggaggatgcaatatcctagagcagtggttacttacataggtgagttattagggaggcttttttttttt

SEQ ID NO: 9437 - DNA, 343 bp, Homo sapiens
catctaaaagatctctggttggatggaaatcaactgtcagaattacctcaggtaagtggtaatttcacagtgtctccccaaaacataaaacagcaacaataagctttgtgtatttcctgctgccacataaggtttgctataaaaggatcttgaaaaccaaaaacattgattgaaaaggcacatttggaaaaaacatattgagcatgcatcattctccattgccatataaaaactgaaaacctcaacccaccatttgtaaatatagtaaatatttcctttagtttgtaaaatctgtattttattgtgtccttgctacccatatagcttacttcaagcccagcag

SEQ ID NO: 9438 - DNA, 514 bp, Homo sapiens
aggggtcctgtcaacagtcagtttatttatatatgcattgtttacaaaatacagcagtctgtttttaagataagggggaaatggtatgaaaaccactgctgtagaaaggagaaagaataagctataaaagcagtgcaaagagaagcattcattgcaagggttctaaatcagaatcataactgatgcctctgtgaaaaagaaggcaactcagaaaaaactgcagggcagccataggaaccccaattaaacttcaagtagaatattctatctcataagcatgaaaacctaaataaaaataatgagtcagaacagaaatcttttgcttgctgtcaagtaaagaatcaattcgtggccaggtgcggtggctcacgcctgtaatcccagcactttgggaagctgaggcagatggatcacctgaggtcgggagtttgagacctgcctgaccaacatggagaaaccccatccctactaaaaatacaaaattagctgggcatggtggcgcatgcctgtcatc

SEQ ID NO: 9439 - DNA, 548 bp, Homo sapiens
agacgtcgaggggtgggcagtggatccgaccagagctgaactttagaaaagatctgttgcttggataaggaacagattcggttgctcaacccaacctgcccctatcgccaatgacccagctcaacgttctctctggtttagaggaaaacaacaggacgttaggaagtaaccagatcagatggtcagaggtggatctagggggagccgggacactctctaacgctcctccagcaggagatgtcctgggcggtgcctagaggaatgtgatggcttcacgcatgtggaagagcctagcgagtgaggctccctgcagctatggatgtccactgcagcctcatgtcctggcctcgccctcccagtatgagcttggaattttcttaaacaagaaatttccagtgttggccaggcgcagtcccagcacctttggaggctgaggcgggtgggtcacctgaggtcaggagttcgagaccagcctggctaacatggtgaaattctgtctgtactaaaaaatacaaaaattagctgggcctggtggcgtgtgcctgtag

SEQ ID NO: 9440 - DNA, 500 bp, Homo sapiens
cttgtccccaaaacataatttccctgctgtatttatctcaatggaatttagaagtagcgtggattatgtcaccctgagagttatttcttgtgtccactaaaagagaaaatgcacagaagaacgtgtctatcttaccgagaccactcatacagtgttggcaagaggacagtccccagagtctcaccatataatgaagctaatcactctatgaattatcttaattgaatttgaatgtattgctactgagtactatgggaagagcggccagtaaggacgcggtattttcccacagcattcagttagcaatgcattcaaatttaattaagatcattcatacagtgattagctttcttcgacgacagaaggcactggggatgtccgtgctacagttgcctgcttttggtctgcctaagataggcatatctactttcacaggttgtctcttgtattgagtacaggattgtttgatccatccttaagtattatcctgagatgtgctt

SEQ ID NO: 9441 - DNA, 396 bp, Homo sapiens
ggagaaatccacagtgataacattttgtgtatttccttccagacatttttttccctctacatgtgtcagcacttcccagatgtgatgatggtatttgaaagagcatgatctggaaatcctgagccgtgctgccacaagaaaatggatgcacagaggacaaggccaggcagcgcaggtcttcattacactgagactttgcctgagtcccatggtgccccagtgccctggcctgggcacatcagcactgccttctgtccaggccccatgagtctcagatggtggaccctggtgacggaaggctgggtagatgccatggacctttcataggtcatagccacagctgagcacttggtgtcttactactcagtggagaggagaagtgtgctgaagggtggt

SEQ ID NO: 9442 - DNA, 359 bp, Homo sapiens
aggatagaggagcatatggaaatgccatctctgaaaaataccattacagaataggcaacaaccttgagttagttggatacaaggaactgggccaaatagcctcttgaaactactttctgctcctcccttcttaccgtcctttcttcctttcatgcatttactgcaggtaacgcatgatacaagtttttttaggagaaagaaatgtggagcccaaaacattgctaatatagaaggaatcaggcttaatttagcatgtttcaaagagccgtgtccaagtcatccaaataaagaccttatttggcaaggtcagctgccctttaaatcaaccctcacaagttaaggtattgtatatggtactc

SEQ ID NO: 9443 - DNA, 450 bp, Homo sapiens
  misc_feature 395: n = A,T,C or G
cctgtgtttcctgttttcttgaaatgaggcagcggtcccaaggtttgcagagtgttaggattaagatgtgtaggttgaccattcctgccgacgtttgccagtgtgttcaacttggctttattggtttgttccttgcttgataaaaattgtgcatcgcagccctgaggaaacgtcccaggtttaagtattagggctttgatgtgcagctgggtaatgtttacctttatttgtgaaaagctaaatccagagtcatcacttgagaatcaagtcactacaataaagatgtttgaaaatgatttttaaaaaaatgttatttactatctcacgacactttggtaggccagtaaatttctgagcctatctaaacagtgagactggagatacattgtgcattntatatcctgttttttatctttttctcttaaacttatttacatcaatataataaag

SEQ ID NO: 9444 - DNA, 453 bp, Homo sapiens
gtgggtctgagtgtggccatataacggcactctggctaatgagacatgaaaggaagtctgtggggtgtgcagggagggtgacagtggggactcatcctcatcagaagacagagacttccagggagactgccctttccttgtttcccttcttcctgccttgaatgcagatgtgacagttggcgggtcagcagccattctgtagtaatgagatgataaggatgacaaagagattgcaggaaatccacccctgccatcatcaaggcaagcgttactgcctcctgatttcttgttatggaagaaagattaacgcctatttttcttccctaaaccactataaattggatttttctttgacctgacaccaaacacattcctatagaattcactgccacacagccgagtaaatgtttgcttttacctggcttttacaactctctgagcttcccaccatct

SEQ ID NO: 9445 - DNA, 286 bp, Homo sapiens
gagttgtcagtatataggaatgctaaatgttaatagacacatggatttcattatactgtttcgtatttgatttacgtttttcataataaagcctggacgcagtgactcacacttgtaatccctgcactttggaaggttgcggcaggaggattgcttgagcccaggagtttgagaccagcctgggcaacatagtggaactctgtccctaataataaataagtacataaataaaaatttgtataatgaaacttttttttaaaccataggaagccgggtgcagtggctc

SEQ ID NO: 9446 - DNA, 438 bp, Homo sapiens
gtttcaacatgtgaatgtgggggaggacacaattcagtccacagcgggtactgtaagactctgggaattaccctgaactagtttattccaagcaggtggccctgagctgtgcttcctttaaaatctatttgtagccttaccagactatattatataaactcctctccacatggccacctctaaaacttcctcagcattttcagaacttaattttgtccaaatgcttcaagtttcttccagatgtctgccatctcccagatacagctacttagcaaaatcagagacattccctgtcatggagacacggcccagttcccatgtggttccagggaagatttggtcaaaacattgcccatttctacacagtgtctaaatggaactagcacccaatggttaaagaatattctcagccagggaccgtggctcacctctgtaatc

SEQ ID NO: 9447 - DNA, 547 bp, Homo sapiens
ggtgagagatagagtaaaccttaatttggatttcagagtagagagtctatcttcttggctatatccacctgatataaaatttctgtcaagatgagcccaggataggtgaaggagaaggtctcagataccatggggtctctgtgctcttattaagttttagtagatttttaaaataacttagttttgttaattaggacgatttctagggacattaagtggttgtgattttaaatgtttttatgctagttaggcatttttcacaagggagtgtctctgtgaaacactacatgtcatcattcttaaagaaaagcactctagtttggtttgtaaaaatgagcatgtatgcaaggaaaaaaaaattatcagacattaaacattatacatagttttaattgcattgatgggagtgggagttttgcattttcacatcttacataatggatgaacagagaactttagttcttagtaagaaaacaaaaacattgaaccatggatagaacagtggggagctctcttttgaacaacttgtaggttgatgagtaaatca

SEQ ID NO: 9448 - DNA, 461 bp, Homo sapiens
aattggttccaggacctcttgtgaataccaaagtccatgaatgctcaagtccctggtataaaataagataatatttgaacataacctacatacatgtttccatatactttaaatcatccccagattatttattatacctaatataatgtaaatgccatttaatttgttatactgtgttgttttgggaacaatgacaaagaaaaatgtctgcacatgttcagtacaggtgcaattatgtctttcaaaatatttttgatatatagttggttgagtcatggatgcaggacacacggatttgagaggatcaactgttctcccttggttaagctgccaattatattattttccttattccatatgcccttggcaataattcttttgtttcgtttttgagatggaatctcgctcgctctgtcaccaaggctgcagtgtaatggcacgatcttggctcactgcaacct

SEQ ID NO: 9449 - DNA, 560 bp, Homo sapiens
gtcgtatgtgaatctgtgaatccttataagaaatgtttattgttcaagaaagaagcctcctctggtggttgataagcaattctccacggcagagaaatgctaatgttttgttcttatgtcttgattgatgctttcactacttattcttcaggctataagacagaaggaaacacagtgttaccttctttcataattacaaattccaacacctctttctcccccccaccccctgtctcccttctacttctcatattaccttaaccatcaaattcaaatgcatctgaatttgtaaagttaatctttcaggttctaaaataaacctgtatatataatatctccattactaatgccatctccacatacgtacaagaaaatgtatagctctacattgtcaatccagacactaaattcattccaaatgtttttaaataaaaataatgaattgatttttatttatggcatgctgcatacacccatctttaagtttcaggtataactacatgcagaaccctcttgttgaaagtgcagagcaacattacagtggctaaatttcaaattaa

SEQ ID NO: 9450 - DNA, 645 bp, Homo sapiens
aatacttaatgagaaatatgttcttggaaaaatagaatatatacaagcaggataatcaagcaggacattctttttattatattatctttattattttggctctgccatgttagcaataataagtaaattctgatcaactaaaatgaaaaatgcataagatggatttaacagtagatttcaataggcaaaagaaagaattcatgaacttacagatagatttatttagactaaacaatttgaattaaaaaatgtgaaaaataaacagagccttagaaaactggaggacctcattaagggcactaatacatgatgatgggagtaaccgaagaagagaagagaaaaaggaacagaaaaaatattcaaaaaataatggttaaagttttcctagtttgatgaaaaatactaatctacacattcaagctcagtgaactccaagtcggataaactcaaagacgacacagacgtatcacagtaaaaatgctgaaaaacaaagacaaaaaatctttaaagcagcaacagaaaaatgactcatcatgtctagtaacattaatggctaaatttcattagaaaaaatgacccgggccgggcggggtggctcacgcctgtaatcccagcagtttgggaggccgaggcggtcggatcatg

SEQ ID NO: 9451 - DNA, 309 bp, Homo sapiens
aggtgcctgtagtcccagctactcaggaggctgaggcaggagaatcgcttgaacccgggaggcagaggttgaagtgagccaagattgcgccactgcactccagcctgggcgacagaatgagactccgtctcaaaaataaaataaaataaagagggggtaaaaaaccataattgtctaagaattgctctgaggattacatcagtgtaaggtaatgaactttactgaaatgtatgcaaaaaatatcactttcattatcattatcatcatcatcatcatcttcacctgatactttaaaaacttcaaatgaaa

SEQ ID NO: 9452 - DNA, 259 bp, Homo sapiens
agtaatagtgattattattatttaaagatgcaactacttctgcaccaatctaatagattacatttaaaatggaagcctttctttgaccttttggtctggactatggctgtacagtgtagcaaagcaaaaggaacatggcggggcaactttctaggcaaacacagcaggagcactacacttactttaagggccctggaaagaggactccaaatcagcatttctactcacattgaaatccaggtctatgtaagtattcttt

SEQ ID NO: 9453 - DNA, 644 bp, Homo sapiens
gttcgttactggtgaatttcaatgtagtgacatcatgttaaatgaatacacagagaatgcatataaaagtacaatccttacttgggccctggagttcgggaccagcctgggtaacatagcaagacctggtctctcaaaaaaaaacacaaaaaaacaaaaaaacactgaaatcacatgtttaaaatatgcaaaccaacttctaccaagttctaaatatacctttgccttctgaaggcttttttaaatactgcacacattttcaacaagcattcctttagtatttccattgtttagggtaatatttagttttctcccatgggacgagcccagatcaagccctcaacttgtcatgacaatgtttattcaggtaaaacaaacaaattgccctctaaaaagtattttctacagctcgaattacccacttacacaagttataacaactattaacaattttatcatttatatttgaagtcacttgctttgggggttttcactgagtgggagtagataactgagatatcctcaaagtcagagaaattctgtgattcaactgctagaggtcatttgatattaataatagttgaagttagtgaagcatgataatctccacattccatttatttacatcatgctcctgaatatat

SEQ ID NO: 9454 - DNA, 284 bp, Homo sapiens
aaaaagcagtcaggtgcaggtttcctatttccttaataagaaagtaagcaattctcttgcaggaggtacagctgggcactggaatgcctggtctcatgatagcattggtttggtcagaacccagtgcaataagcttgtcaagccatgggaatcagtgagaattctaagccccaaacagaaacaaatgaactgggtttttacaggcagtgccttcatctataactgcactcagagttctttggactcatatttttaagtcaaagagaatgcatgcttggagcacg

SEQ ID NO: 9455 - DNA, 484 bp, Homo sapiens
tgagcccagaggtaacttcagaatcctccctaacacaaaactccagcggtcactactgatgcaatacatgttgactatcacaaattcaagcccacctaaaagagagaagaacaaaagcagtgcaactggatagagagctatggctgaggccaactatgatcaaatttattgtctacgaaaacaagtaaccctggtgactgagagatttattaaataatcctttgggctttacatagatactgggtataataatcaaatagcataaaataccaaaatataattgtcaagatatactagggagtggtaaagatacggaaacatgttaaatattatctgtcatgtatattaaaagagatataggggtggaaaaccagtgctatgaaaaataagtgctaaaaacatggcaaagttcaggaaatggagggtccattgtggtaatctagagagctttcatatggatatactaaaacttaagacagacctt

SEQ ID NO: 9456 - DNA, 487 bp, Homo sapiens
taattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaa

SEQ ID NO: 9457 - DNA, 51 bp, Homo sapiens
gtaagccacctcctgtctcttcctccctccttctctttcatgcgaacacag

SEQ ID NO: 9458 - DNA, 559 bp, Homo sapiens
agctccccaagataagaacttggctgccagagggcattaagaactaagggcactaacatatgggctatacggaagtgagaagcgccaggaaaaataaccttgtacatctttccgtgctgggaccttgtactaaactgagaaagtattttcagctgagttacttggtgaggtttacaccctacccacctagaatccttgctgctcccagatattccctctctttaaaccaaatctctggttttttaaacccatttctacttaagcattcaactaatgaaatggtaaggactgtaagaggacttgagcaaactcactgaatggctgacacagaagtcttagaaggaggaccgggcgcggtggctcacgcctgtaatcccagcactttgggaggccgaggcgggtggatcatgaggtcaggagatcgagaccatcctggctaacaaggtgaaaccctgtctctactaaaaatacaaaaaattagccgggcgcagtggcgggagcctgtagtcccagctactcgggaggctgaggcaggagaatggcgtgaacccgggaagcg

SEQ ID NO: 9459 - DNA, 662 bp, Homo sapiens
ggaatgctgtcgggactgagcaggcaatggcctaaaaacaataaaaagccctactaaaagctggttttctttttattattatcctgtactgacaattcttagtaatatcagtgatgaaataaatcactggggaagacctctcccacaccagcccctagttgatatggcactgtgaaagcactccaatatctttctttctttttttcttttttgagacggagtcttgctctgtcacccaggctggagtgaagtggcgcaacctcggctcactgcaagctccgcctcccgggttcaggccattctcctgcctcagcctcccaagtagctgggactacaggcacccgccaccacacccgactaattttttgtagttttagtagagatggagtttcactgtgttagccaggatggtctccatctcctgacctcgtgatccgcccgtcttgtcctctcaaagtgctgggattataggcgtgagccactgcacccggcttccgatatctttcttaggaaggatacatcatcatttaaataatgaaagcaatatatattcactgtagaacatccagaaaaatttgaaaaaatatttttaggagagaatcaaaattcacattaactccaccacttattgataatcatagatctttatgtcattattactt

SEQ ID NO: 9460 - DNA, 526 bp, Homo sapiens
gcagactcctgggttcaaatgatcctccagccttggcctcccaaagtgctgggattacatgcatgagctaccacacctggtccattattatgaatttaaactgcaggctgatgattccagggtcccaaattcactgacagcaggcacgctggtcttgcacaattccccagagcagatggcccttcctacccatagaagcccatgctcttagctctcctacaaacctatccttagaaatacgaagtgctggccgggcgcggtggctcacgcctgtaatcccagcactttgggaggccgaggcgggtggatcacgagggcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaggcggagcttgcagtgagccgagatcgcgccactgcactccagcctgggcgacagagcgagactccgt

SEQ ID NO: 9461 - DNA, 83 bp, Homo sapiens
gaaggagtgaaatggcatgaggcctgcgatgctctttaaaagatttcagcaaagagaaaaaaagtagaacacaataaatgaag

SEQ ID NO: 9462 - DNA, 265 bp, Homo sapiens
gtttccagctgacttgggaactgcaagtctgagtctaacagtttttggcttaaattctgagaatcaaatagaagaattttaaatacaagagtttgagattgggtatagtggctcacacctgtaatcacagcactttgggaggctaagaatcacttgagactaggagttcaagatcagcctgggaaacatagtgagaccccgtctctacaaaaaatataaaaattagttaggtgtggtggcatgcacttgtagtcccagctactca

SEQ ID NO: 9463 - DNA, 594 bp, Homo sapiens
tttattagacactttaaggaaatatgagatttggaacacagatgttcatcataaaacataatactgaaagtttgagaatgaccaaaacatccaaaaataaggaaagttataaattaagatttatccatataatggaatatgaaacaaatcatgtcttcaagaatttaatgacagaaaaatgtccagtggatagtagttttcaaaagctaggaaaactacattcagcatgatcccaattttatgtaacaaattcgtaaggaaggaaatttcttaacttacacatcaccagccattctttctaggttgtagaatgacaccagtgtgggttgtgggtttttgttttttgttttgggggatattttctgtccatttatgtcacttttacaattaaagaaacacgatagattcacttatgttatgaatctatattgtctgaaacttttttcttaaaaaaatgattttcttaggcttcttcactctctctgactttactagctctagtaattgacgtacttttcataacagttttaagtaatcaaacagttatatcacttcagaagtgaaaaactctttgtcttcaaagacatctctact

SEQ ID NO: 9464 - DNA, 667 bp, Homo sapiens
caaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaact

SEQ ID NO: 9465 - DNA, 329 bp, Homo sapiens
tgtatctatgtaaatgccttttgattctgcaactgcaggatactctcatcaaagacacagataaaaagcctctgtgtttccaaggccttgccctatacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggtggctcatgcctgtaatcccagcattttgggaggccgaggtgggcagatcacctgaggtcg

SEQ ID NO: 9466 - DNA, 178 bp, Homo sapiens
cacattcttggtctttccttttcaagatgagtgcccttttgtgctttgcaccccataggtggttattaaatacatgttgattggttggttggctgtttgtctggttagaagtggagagtcagagctaggtggaaatagcacttgcaaccattgcagctgctgttggaatgacacaggc

SEQ ID NO: 9467 - DNA, 652 bp, Homo sapiens
ggcacgaggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatgggga

SEQ ID NO: 9468 - DNA, 591 bp, Homo sapiens
ggcacgaggtcacaggatctcaaggcctgcctgttggtggccctggttccttgaagctgagggtcagaacctctgtctctggctgctgcctcagggcaggggcctgggacagcccattgcaggccaggtggtcctcccaggagactttgtggggccgaggagaaggcaaagctgccttgcatttgcctggtgcctgctaagccccaagtccatccctcccctgaacaggacgctcgcagggccctgcccgtcagaatgcacgtggagtcctctgaggttcgggggtgtgggttgcacttgagggaccatcttcctggagatcccgtagggagttccctacaggcaggacctgaggcccagccccaggacaccaccccaccttcccggggcttgggaatgttctgagcccagcttcctgtcgaagaccgccatcttgctcctacgactcctggtcaccgtggtcccgggcccttctctgaaaaggggcatccccagcccggagcgtgatggaccaatgcgagggcctgagcccgagggtgcggacagtaaaccgtttattactgtgtggacacagacaccgtggtgcatgac

SEQ ID NO: 9469 - DNA, 468 bp, Homo sapiens
ggcacgaggtagaattgtccctgggtcttaacaactcatttgtaactgatccaggtctcctccctctgcttcctcaaacccaggcttcgctgcctctgcggagttcttacctgtctctcctttccacccgggttccctggaggaagctaaactcagaccaaggccctgggctccccaggagttaaaagggaatacgctgtcccaagattctagaatgaagagtcaacgtagcccgagtggcttaaacctcctgtccttaaatgcaagaaatgttttctatcgagccctggacaggtgtctctgctggcctggggttttcaacaggtcatgcctgcctcagaccccagggacaaatgttcttccagctctaactcattctatgctttaagcttttgacctatctttgttttcccagtgccacaccaaatgctgcctggggatctctctttcttcctgagttcccatata

SEQ ID NO: 9470 - DNA, 516 bp, Homo sapiens
ggcacgagagagagagagagaactagtctcgagagcagttttttttttttttttttggcttggtttgaaacctttataaaaaaaatttccttttttttaaaaaataacaaacccggtttttggacgggaatccacccattttggccccgggatttttcggggacccttcggaaaaagctaaaatccccctttaaaggggggattgaaaacccccccaaataaaccttttaggaaaaccatttaaaggttttaagggattttggccccttcccaacctttttataatttgggcagaaggcccaacctttgggggcgattaaccccccaccaaggggcccatttggaaaaaatccagaatggggtttttggggcttggggccgcccttcctaaaaaaaaccttttttaggggaaaatcttttttcccgggaaaaaaattttggggatttttttttttttaaaaaccttttaagggggcccccccccccttcccccccctggaccaaaagggcaaaaaa

SEQ ID NO: 9471 - DNA, 562 bp, Homo sapiens
ggcacgaggtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctgtaacgcttggttttctcccccagatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacgtggtgaaataggccaaagatttcttcttcgttcaagatgaattctgttcacagtggagtatggtgttcggc

SEQ ID NO: 9472 - DNA, 572 bp, Homo sapiens
ggcacgagtgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgc

SEQ ID NO: 9473 - DNA, 593 bp, Homo sapiens
ggcacgaggatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgt

SEQ ID NO: 9474 - DNA, 587 bp, Homo sapiens
ggcacgagccagactccttcctcgaacccagagccttctcccatagtatctctttagcctcttctgccttctagactgtccctgcctccagggacaccatactcacctggccttttccaggagggcctcctagaccgaacgcaagtaagcacagcttctcctgagcccaccctctcctctacttcctccccaccattatttgtaaggaaactcttctctttactccccaacattctccatcccccttccttggctgcctcctcccttcttcttcccagcctctcctttctgcccggcacgggctttcccaccggaactcttggctcagaaatcagttgggacaaagcccctgtctctgccagtctggcctctatccagcccctcccttcccccaccctaccttttgtgaaagccttgggctggagggtggactaaggggggggagaataaatgggaggggctaccccttcctacccctggctatcagaagctctagaacccagaatattcctccaaagatctcgaagcacttacactctcataaaaaggatgtgttgtgacattgagaaatggagactgaggctcag

SEQ ID NO: 9475 - DNA, 379 bp, Homo sapiens
ggcacgagggtctgtggtcttacatgatgagtgccacccttgccaatttgccttcttcatcctcctcaccccctaagacttcttgattgcccttggggtctcaggacattctcttttccacctcaccgtgaatgccctggctcaggaccgacactttcctttccaaagtctgctttcagctaactcttggaaggaaatctctcccatgtttcactcaaaggtataaatgcctgatgaggcattacagcaacttatgctgaagttagttttaggtgttgggcatggagatcctgtcacaccttacagggtagctggctgtctcttcccatctctcggtccagtgaacccttagaaaacaatgccaagagtctcctagttt

SEQ ID NO: 9476 - DNA, 222 bp, Homo sapiens
ggcacgaggctaggaccttaagaaggagctcatgtgagtcaggaccctgaatgttaggcctcgttagctctatggttcatatgcttcttgaaccaagtcacagggcacttcccagccacattgccaggcaacaggactaaactacctccaaagcaagcagtcttttcagttttgactgagtgatgtgagaaacttcttttcttttcttttcttttttttttt

SEQ ID NO: 9477 - DNA, 208 bp, Homo sapiens
ttcgaattcggcacgaggactaagtcggctacagggagtccgcgcgctcggccaggcagcctctgacaatagcggcccagaaggcctctagagatatgccgagacgcattacatatggccgaccttgagaggaaacgtacgaggagcttgggtcactatgcgcacactgccaatagcacatggagaacgggctctatctcgccgaggg

SEQ ID NO: 9478 - DNA, 612 bp, Homo sapiens
ggcacgaggttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttc

SEQ ID NO: 9479 - DNA, 629 bp, Homo sapiens
ggcacgaggggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctga

SEQ ID NO: 9480 - DNA, 400 bp, Homo sapiens
  misc_feature 307, 362: n = A,T,C or G
gaattcggcacgagctgggccgtttctcttttttttccggaccccgcagtggcgcctaaagtctgcaaggaggaggtcgcctctgtgctgtgagtccaggaatctaaggcgagtgctgagggagaaaatgtagttgatggggcagagcagaaggggctgtaggtgggttggagggggaggggaacgggcagccaggcctggaccctggggagtgactcacccggagccgaagaccatctcagctttccctagcccagaaagggtgggactggctttatttctgcctgccatcacctcaaaatgccgngggacaaatcttacatattattattggtatttatttatggattttattttttttnggacagtctttgtctgtcacccgactggagtgcagtgg

SEQ ID NO: 9481 - DNA, 613 bp, Homo sapiens
cggccacgagggctccagagagagccatgtggagggacctaggccagcagctgacccagggctggtgactccaagatcatgactgccccagagaggatgtcagaggcaggagggccgatggcagttccacagatggcctcagagcacctgctctgggccagggccccccactgggtgctgagcagagagtggtgaacaggcccgggcagcaagctcaactctgcctgcacgtggggctctatcagctgctgacctcaggcctaccccacaccagctacatcaaaatctttgtaggtggaacctagccttgaaaacctttgtctatttttattttgtttgagacggagtctcgccctgtcatccaggctggagtgcagcagcacaatctcagctcactgcaacttccgcctccagggttcaagtgattctcctgcctcagtctcctgagtagctgggactacaggcgcgtgccaccacccccagctaacttttatatttttagtaaagatgggatttcaccatgttggtaaaggctggtcttgaactcctgggctcaagtgatgcacccacctcggcctcccaaagtgctgggattacatgcctgtaggcatga

SEQ ID NO: 9482 - DNA, 386 bp, Homo sapiens
  misc_feature 190, 205: n = A,T,C or G
cgttgctgtcggtttagcccttgttgcctgggctggagtgcagtggtgcgatctcagctcactgcaacctctgcctcctgggttcaagcaattctcctgcctcagccttcctagtaggattataggcgcctgctaatttttttatttttagtagagatgtggtttcagggtgttggccaggctcgtttcnaactcctgacctcangcaatccacttgcgctcatccttccagactacaggtgtgagccaccgcgcctggctaggaatttattgataaagatctttatgctaacctcaatatgagtgacaaagattgggggaacatagcctgatgaggtccttagaaaacgtgcccctgggaaaaggaatttatataaaaggcgatg

SEQ ID NO: 9483 - DNA, 389 bp, Homo sapiens
cgttgctgtcggggcaatctgagtacgatccctgttccaggcatgacaggtgattggctctagtaaaaactgatgcagtgacattattcttagtgttttcaaaggagagaaagctgaagaattcgtggccgcaggagtttttttttttttttttttttgaaaaaaattttttttttgccccccgggcgggggggagggggcgaattttgggttaatggaaccctccccccccgggtttaccccatttttctggcttaaccttttggagaagtgggaataaagggcccccccccccaccccggcttattttttggttttttaagaaaaaagggggtttccttggttaacccagaagggtctaaatctctggccctggggacccccccccc

SEQ ID NO: 9484 - DNA, 677 bp, Homo sapiens
ggcacgagggagcaaaggctttcgggagtgtgaggctgcatctgctggagcaaagggaaaccgtgggcttttccggccagatactcttgagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttactttttcttctcagatttctcccttcctagaacattctctctgtttagcactaatgttcacctcgtattttttggaagtgcaaaaatctcaatttgtgtctgtttacagctctctc

SEQ ID NO: 9485 - DNA, 89 bp, Homo sapiens
tgatgatgaggaagctgaagaaaagcgccagtgaagaaatctatacgagatactccagccaaaaatgcacaaaagtcaaatcagaatgg

SEQ ID NO: 9486 - DNA, 85 bp, Homo sapiens
ctcaagcatcctccttcctcagactcccaaagtgttgagattacaggcatgggccaccatgcctggccccagactgagttttttg

SEQ ID NO: 9487 - DNA, 573 bp, Homo sapiens
ccatcaagtttttttaaaaagcttatgcagcattagaggaatttattttaatgcacatttatattcaacatagacattaattcagatttttacttgggataaaacaaattctagttttccctttgttttgaaattacttttaaaatatgtctttatagataaatataaaatatattaagcattttgaacagagcttagaagacaatatttagtactgtttctgaatatttctttatatctgaaggggaaaagccatcaaaatatgtgaattaaatacctaaaattctggttgtcaaaacgtcacacttaaccataactttaaaggtagaaaaacccttacaagtgaccaacccactcattggatagctaaggaaacacaaaactcaaataatttgctacacatcacagattggggtcttagtcttatgtcttctaactttataacggtatactatttttttcatgtttttattaaaatgttttcttaaatccttagccaaagatttttgtttgataagtcaaaaataaggtcttgtttactttgtttacttttttgtattcaagatttaactc

SEQ ID NO: 9488 - DNA, 111 bp, Homo sapiens
gtggagtctgtgatagccaaccaaaagctatccccttctcgcccagaaaagccacgtgctttgctggacgctacttgaaatctgaactctgcacctacatatgtagtaaaa

SEQ ID NO: 9489 - DNA, 385 bp, Homo sapiens
cgttgctgtcgcggccggaattcttcccgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagagggtgttgatgaagaaattgtttatgccaaatcaactgccttacagacatggctctttggttatgaactaactgatactatcatggtcttttgtgatgacacaatcatctttatggccagcacgaaaaaaggggggttcttgaaacagaatgccacactaag

SEQ ID NO: 9490 - DNA, 623 bp, Homo sapiens
ggcacgagggcaggcagatcacttgagcccagaagttgagaccagcctgggcaacatggtgaaacctcatctctacaaaaaatacaaaaattagccagacatgatggtgtgtgcctgtggtcctagctactagggaggcagaggtgggaggatcacttgagcccaggaggtcgaggctgcagtgagctgtgatcgagccactgtactccagcctgggtgacagagcgagaccctgtcttaaaaaaaaccaccaacagggaaaggccaggacgacgaggagaagttggtatctttttgttagctccagagtttgtgctggtgaaagaaggttaggatgtagaaaagggatttagagacatacagtggctgctcttcagtattcttcaagggtccaagtgaagaactggaattttttcaatgacatgcaacagttgacctgtgtttcaggaagtatagccttgagctgagtctcagccatgtgggaccctcggaagcagctacagcttcttagtataggtcgagcgtcccaactccgaaaaccccaaattttggagcatttcagattttccgagttgggatgctcagccagtacgtatattgcaaatacagttgtcccttggtct

SEQ ID NO: 9491 - DNA, 84 bp, Homo sapiens
atgctccctgtcccatggagagggacccagcataggaaagccacatactcagcctggatgggtggagaggctgagggactcact

SEQ ID NO: 9492 - DNA, 603 bp, Homo sapiens
tcaggaggctgaggttgcagtgacccgtgatcgcaccactgcactccaacctgggtgacagagccactgcaaagcactctgtttagtcatggtttcttttatgtattctttcatgtattgaccttaaaaaagaatgtttctgaatatgcctttaatctgacaaaccaccaccttaatattcttttaaaatcagtttgagcctacagccatgccactgtgaatgtgtctgatctcatgtgatcatggaagctaaagtgagtttgatatgataaatatatgcaacgtaactttaaatataacttttaaaaatatgtttttaaggccagatatggtggctcacgcctgtaatcccagcactttgggaggccaaggtgggaggatcacctaaggtcaggagtttgagaccagcctggccaacatggtgaaaccccatctctaccaaaaatacaaaaattagctgggcgtggtggtaggcacctataatcccagctactggggaggctgaggcaggagaatagcttgaacccaggaggcagaggttgcagtgagccgagatcgtgccattgcactccagcctgggcaacaagagggaaactccatctc

SEQ ID NO: 9493 - DNA, 649 bp, Homo sapiens
ggcacgagaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgc

SEQ ID NO: 9494 - DNA, 413 bp, Homo sapiens
agagcttggattcctaaagaccttatactggtcccaactgtaccacctaatcatgtgtcccttgagtttgtcacgtgacctttgctttcctctgaaaatccttttactcagtaggccaattaaacccatttataataattaataaaatcaatatgtttgacttcaagtttttcccttagttttatgattttttaaaagtattatccttttttggcatttaggaaggcatctatttttgttttaatggttactttgatgtaatactttttttttctgctcttgtgtattgattcccgctgtgagtgataaatcagtcatttaccttttcttccccctcctctctttattttccatcatataacttgaaatattatccttttttttttttttaactcccggaaaaacccggaaaa

SEQ ID NO: 9495 - DNA, 509 bp, Homo sapiens
ggcacgagccgggcccggccctggagatggtccccggcgccgcgggctggtgttgtctcgtgctctggctccccgcgtgcgtcgcggcccacggcttccgtatacatgattatttgtactttcaagtgctgagtcctggggacattcgatacatgttcacaggcacacctgccaaggactttggtggtatctttcacacaaggtatgagacagattcaccttgtccccgctgaacctccagaggcctgcggggaactcagcaacggtttcttgatccaggaccaaattgctctggtggagagggggggctgctccttgctctccaagactcgggtggtccacgagcacggcgggcgggcggtgatcatctctgacaacgcaattgacaatgacagcttctacgtggagatgatccaggacagtacccagcgcacagctgacatccccgccctcttcctgctcggtcgagacagctacatgatccgccgctctctggaacagcatgggct

SEQ ID NO: 9496 - DNA, 656 bp, Homo sapiens
ggcacgagcccaggctcaccctacggaaagagggggccctgctggccccacaggacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctg

SEQ ID NO: 9497 - DNA, 382 bp, Homo sapiens
cgtagctgtcgggagggtttgaaggagaccatcagctattgtgtgatatcagacaccatggtgatgtaacggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcg

SEQ ID NO: 9498 - DNA, 565 bp, Homo sapiens
gttgctgtcgggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggct

SEQ ID NO: 9499 - DNA, 582 bp, Homo sapiens
agacaaaatagtactcatgataaaacctacaaggaaatagacaatagaatgaggcagaggttgcagtgagctgagatcacacattgcactccagcctgggtaagaagatctcaaaaaaagaaagtgtcatcatctactagattggaaatatcagatattcttgagtctttcttctccctcatatacagttagtcatccagttcttcaaaatctcgttgaaatgtggcttcccctccagccagtctactgcctatcagtacttacctgtctgtgcattagcccccaccgacctctatcccaccagcatctccctgtggcgctgtgcagtctcgctgttggtcaccttcctcatcagaacaagcctgagtgtgccacactcctctccagaagccctgtggtcttgatagagagaggcaaatagggtggctcaaagaacagacttgaactagactgcctgggctcctgtcctccctccacaactcaccagccacaaataatgagaaaggtacatttgctagggaaaacatttaaatacaaatactcatcttgatgtgtttaaacatgttgagacagttctgtctg

SEQ ID NO: 9500 - DNA, 334 bp, Homo sapiens
cggggaggctgaggcagaaaaattgcttgaacccgggaggcggaggttgcagtgagccgagactgcaccactgcacttcagcctgagtgacagagtgagactccatctcttaaaaaaaaaaaagtttattctttcctgtggggtaagcagagctgaagttttaaaaagacagggggggatcttcattagggaactgggcaatgggcttctcatgttaacaatgttgacaacaacagccaaaaggaaaaatgtaaaaaccaaaaaaaaagctggcgcaggggctcacgcctgtagactggcactttggatggctgaggcggggattgcttgaggc

SEQ ID NO: 9501 - DNA, 432 bp, Homo sapiens
atacattatctgagcctacatacactttgtaaaaagtatacttccactgttcagaattagatgatggcacaaaacctgttgaggtcttcattcatccttacaaatgtttattatgctgagtgtcccaggtgactggatacagtggagtgaattagaaatttgaaattattgccctgaggggacctacattcttcttgttggagtgcgtctgtgtgggataaggtagacaaataatataggaaattcaaaaaattgtttcagaccatagtaagttctatgccagaaatgaatagtccatatgataagaggaacagacattgtgagatgttggatctataggaaaagaggaacagacgccatgttcaggccatggtgcatgtacaaaagacctttttctgaaatcagtgcaggcagtgagtggccaggtgtatt

SEQ ID NO: 9502 - DNA, 603 bp, Homo sapiens
gaataacccagaaatatttcttactgttgataatctgcagtttgcaagtgcagcgaatcttgtaggtagatttaccttgagtttttttgaaacggtagaattaatatattaaaacatatggtttttagttaaaataggatgttaaaggaatagagcgcacgaacaaaaaaactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgaatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccttaggaagacagacagactttgcaagttagtaagctaacttgctagaggaaacggtagactcctgtgctggctgccaactaaaaagcctttctccacagttctgttctcatgtacacc

SEQ ID NO: 9503 - DNA, 489 bp, Homo sapiens
ggcacacgcttcctggggccattccacattcctgatgtcccatgtcagaatgacacatatactgctaattcccctatgcgagctctgatgctccagctctctgccctcccctccccgctcccggcagcatggcagcagctggggcctggcctccctggtctgcctgggttctagcctgtgacaggggcccatagaaaaagcactgaggccgggccaggcacagtggctcacgcctgtaatcccagcactttgggaggctgaggtggatggatcacgaggtcaggagatcgagaccatcccggctaacatggtgaaaccccgtctctactaaaaatacaaaaaattagccgggcatggtgggtgcctgtagtcccagctacttgggaggctgaggcaggagaatggcatgaacccaggaggcggagcttgcagtgagcggagatggcaccactgcactccagcctgggcgacagagcaagactccggctc

SEQ ID NO: 9504 - DNA, 61 bp, Homo sapiens
tggtcaaggtcactccccacccactgggcctaccgctctgtaatgtggctgtgtgtctcta

SEQ ID NO: 9505 - DNA, 494 bp, Homo sapiens
agaaggggaagttagaaagaatgtggttggttagggcttccaggcttccaaatgcctggaagaaggtgagtttttatatcagctccagcatctgtaggaaagccggagaagaacactagcatccccagcatcccttctgtggagctgaacccctcagcctctccagataggggatccttgttttcatccctggagacccagccctcttgcaaatggctctccatagaggcaatgtctccagagagacttaattggcaatgcttcactgagcacagaaacctgggatatgacagttcctgctctttaaattgtcaaggaaggcaatgtgctctgaactgcagctgctgggagtgcagggggacccatcttagagtctcctccgccttccagcctctgcttctgaatgttctgggaacaagaaacagcaacagagaaatgaacaggtagatggagcacgatgagcaacataagctcaactagcctttttatggtca

SEQ ID NO: 9506 - DNA, 525 bp, Homo sapiens
ggtactcacaagttaacaaacttcaaaatgctatttgaaagggaaactaataacattaaaaagaggtcacagtactgtttgaaaatctacaaaggagtcatgatctttgttcaaggaagtaaaatattaaggaaatttgtgttagttgagttcttgactgaacatgtgctatgaatttctgattgtggaagctgcttcctattcgaaaataaaataaaactctcttggtatgcaaatgataagaatatgttttggtatctaacaatatctaaaagcaaactctctgcaaagtatcccagaatggtttacttaagaacatcctggctgaacttcaaagtagagcctactggaaaatatttacccagactatttgaaaagagatttgaaaagagagtttcattgatttccattgtccagctttatttcatggatttctatcatttgactgtattttttattatcagtatcattgccacaagaaagtattacagtcaagagatgataaataataatgatgatagtaat

SEQ ID NO: 9507 - DNA, 535 bp, Homo sapiens
gccactgcgcctggcccttgcttaattatttcaatagcactgtaacaaagatactattactatcccattttatagctaaggaaactggtactcagaggcctcagaactggtaagtcactaaatccagacctggctgactctgatgcccatgccctgaacatagcacttcatataataaggccagcagagataccagagaggagacctcgatctgggagtcatttacacagagggatagagtgtcaaaaatagaggggcagggctgggcatggtgactcatgcctataatcccagcactttgagaggctgaggcaggtggatcacctgaggtcaggagtttgagaccagcctgaccaacatggagaaaccccatctgtactaaaaatataaaattagctgggtgtggtggtgcatgcctgtaatcccagctactcgggaggctgaggaaggagaatcgctcgaacctgggaggcagaggttgcggtgagccaagatcacaccattccactccagcctgggcaacaaaagtgaaact

SEQ ID NO: 9508 - DNA, 587 bp, Homo sapiens
gatgggggaagaaccaagcccttttctttcacagctgggaggcaggtagcccagggcaaattttcaagcccgacatgccttccacctggaaacagactgggggttgttggggtgtgcatgatgggggtgagactggcccttcagtttgcgtgggagctgtgtgaggcctgtgactgctggctttcccccacttccctgacaactgcatgactcagcagaggcagccacaatcctcctaggtacacaactccagtgacctgggaatctcacccccatcccccacagcagctgcagcaagacctgcccaaggagagtctgagctcagacatgcctaggcctgcccccacctgatggttcttccctacccatcctggtagctgaagacaaaacgcatataatcttgggagttctagggcccaacccaccaccagtccctctccacactactagagctgatgctttctggaaagcatcacctcctggcaggaggccaaccagcactaaaatagaccattaaagcaccaaagctgaggacccccatggagtccattgcattcccctcaaccatcttcactggaacaggcgct

SEQ ID NO: 9509 - DNA, 337 bp, Homo sapiens
ctctgcctcctgggttcacgccattctcctgcctcagcctccacagtagctgggactacaggcgcttgccaccatgcccagctgatttttttgtatttttagtagagacggggtttcaccgtgttagccaggatggtctcgatctcctgaccttgtgatccgccgacctcggcctcccaaagtgctgggattacaggcatgagccaccgcgtccagcctctgattgctgtaccttttgacaggactcttgagtgttggttatgttgggcataaagtttattttccttagaattttacttttgagcattctttgtggccttgaaaggaaagggctact

SEQ ID NO: 9510 - DNA, 610 bp, Homo sapiens
tgggaccctgacatgtccatggagaggagctgggtgagggagactgactgtgagcaacccagaggagaaaggagttgggggactgtcatggcccatgccacaattgctgtacctcctacctgttctgacattgcatttggcaaaagaggggttggattctggggtgtgagaaagaaaaaaaatgtctctgggcattgagcaacctctctcagcaacagcactcctcagaaagggtaataatgtaaacattcacccattagaggaaaaaacttagcctttatgccaccctctccaccattaacaacattggcagccctattaaagtacaagtcagatttgtgtttaatgatcttgaaagtaaagtaattgcttgagtgttaccattcaaatgttcttagaagtgcagataatatttacaattggattgtcctttcggaaggggtaggcaggcagccttcctccgctatttgaagctgaggctggggagaagtgacttcagcaattggcttatgggtctaaaagctcagcgtttattttcgtttcttcttttcaatatcaagagactccagagcattagccatacctcattccttcaaggaaggagatgctg

SEQ ID NO: 9511 - DNA, 156 bp, Homo sapiens
tagtttaggcaatattaacaccttacatctgtaattttagcattttgaatacacagtttttaatgtacattatccattgggcagatccatagaacaagctaaaactttccagattcacattactttaaaaatattttgatttgctgggtgtggtgg

SEQ ID NO: 9512 - DNA, 553 bp, Homo sapiens
taagtaactttcatcctagttggaaataatcaccacatacttgcaagaaagactttatccttatcctcttgttctgtcttctgcttgaggctttggataaaggcaaagcccttttaagcccaagcaggacaaagtccaaatctgaaaattgcactatcctccaaaggtcttaccttccaatgagtcagataattttggatcattcccattaatgagtcatgctgaccaaatgtagtttttgtgtatttcttgctacaacttttaaatattcccttccttccctttctacatttgttgagtgactactgtggaaacaagactcagaaagttaacaggctcttgtataaaagtattttagtaatttaacaaactagtgttgctgggcgcggtggctcatgcctgtaatcccagcactttgggaggccaaggtgggcggatcacctgaggtcaggagttcgagaccagtctggccaacatggagaaaccccatctctactaaaaatacaaaaaattagctgggcatgctggcaggtgcctgtaatcccagctactc

SEQ ID NO: 9513 - DNA, 532 bp, Homo sapiens
gagatcggccactgcactccagcctgggtgacagagtgagactccgtgtcaaaaaaaaaagtcccaaactgtttggctttatttaggcagtaaatattctacttcgggatgacctgtcatggagccagtaaggcctctacaaatcacatcccaaacaaatacaactcagatgagcaaagtaaggcccagatgaaatgacatctcgatctcttctatggcagaaactcagcaagacataatgaaacaaagatagctaaagttcattatttaatgctctactcccaagagaattatgggactttaaggctactcactaacatacaaaattaccatgcagatatggggggaaagtccatgtccagaaaaaacttggtttgcaaaccttagaactatgtcattgcaggattatgtgtgtgtgcccgtgtgtgtgctcacaggctttgaagagttttatgagtatccattatccaaaatgcttggaaacagaagtgttttggattttagattttgaaatatttgcattatacttaac

SEQ ID NO: 9514 - DNA, 366 bp, Homo sapiens
ctccccacccctgctgcacacctacactgaaggaaggctatttgcagatgcagcaagaaggcagccatctgcaaggcagaagaagagagccctcaccaggaaactgataagtcagtcagtctgggactttcagcctctagaactgtgaaacaataaatttctgtggtgtaagcaactcaatctatagtagtttgttactattttgttatagcaaccaaagatgactaagccagacaggttatgtcactcgccaagtgtcttggtctgtttgtgctgctataacaaaataccttagactgggtaatttacaaacaacagagatgtatccagagatccacagttctggaggctgagaagtctaaaatc

SEQ ID NO: 9515 - DNA, 359 bp, Homo sapiens
ggcacaagggcaagtttgggcacgagtttctggagttcgaatttcggccggacggaaagcttaaatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgt

SEQ ID NO: 9516 - DNA, 300 bp, Homo sapiens
tgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaat

SEQ ID NO: 9517 - DNA, 624 bp, Homo sapiens
cgaattcggcacgagccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccag

SEQ ID NO: 9518 - DNA, 512 bp, Homo sapiens
ttttgaactatcaactagatctgggaagatagaacaggctgtatcagattgccttgtttacaaagtgtcatcacgaaaagtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcctttttttctccttttgtgaaagtgacaggtacttctggtctgagtccataaatcagctatatctaaatggaaaactatatcccactgggatggtaatcacccttttgatagaaaggttagaagccagattcttcaacagaaatggaacttatcaatttaattaagattcctcaacagtagatttttaggtcagtggaacccctgtgtaaagcgatgtgctact

SEQ ID NO: 9519 - DNA, 438 bp, Homo sapiens
tcagcaaggtgaaaccctgtctctactaaaaatacaaaaattagccaggcgtggtggcgtgtgcctgtagtcccagctacttggggaggctgaggcaggagaatcacttgaacccggaggcagaggttgcagtgagctgagatcttgccactgcactccagcctgggtgacagagcaagactccatctcaaaaaaaaaaagaagatggaattagctgagtttcatggctgcttgggaggttttttgcagacaaagactccctctctcacccagactggagtgcagtggcgtgaccctaactcactggagccttgaactcctggtctacggtgatcctcctgcttcagcctaagtagctgttattggcatgagccactgtccctggctcacatggctgcttaaatggaagagttagcagttgagactgagaaacatgaa

SEQ ID NO: 9520 - DNA, 397 bp, Homo sapiens
gaaaccccgtctctacttaaaacacaaaaaactagccaggcgtggtggcgggtgcctgtagtcccagctactctggaggctgaggcaggagaatggcgtgaacccaggaggcagagcttgcagtgagccgagattgtaccggggggctccagcctggacgacagagagagactctgtctcaaaaaaacaaacaaacaaaaaaaaattgtcaacttgtcctgaaggagcaaaaagagtaactgaataactctgatatttttcttcaatcctgattcaatcacttattctttcagaaaacagaaaattttaagaaatggcatttactggacttaaagacttactcatcatcttcccataatcccacctccagaaaatcaccattaatacttccatctac

SEQ ID NO: 9521 - DNA, 603 bp, Homo sapiens
tattaaattttccctgtccaaatttctgcggtgatttctgtcccttgcttgaactctgatacaacatctaaggacgctttggtctttgattcttgtctttgaaagacgatggcaaggataaaggagttgtgtgtgtgcgcgtgcgcgcgtgcttgccattaatacagacttaaaagcagcagagtagcagagtggctagtacagggtactccagccagattggctttgccacttcctagctatgtgccctggggtgaggggagttgcctcagtgtcctcatctgtaaaatggagatagagtggctagaatatacccagttaagtttgaatttcagaaaaatcacaaataatttcttaatataagtatatcctaaatattatacgggtatccttcctgtattcttatttgcgaaatctgacaagactagtattacatcataaaaggttaaattaaggccgggcgcagtggctcacgcctgtcatcccatcactttgggaggctgaggtgggtggatcacctgaggacaagagttcgagaccagcctggccaacatggtgaaaccctgtctctactaaaaatacaaaaaattagctgggcatgat

SEQ ID NO: 9522 - DNA, 253 bp, Homo sapiens
gagacagggtctcactctgtcacacaggctggagtgcagtggtgcaatcataactcactgcagcctcgacctcctgggctcaagcgatcctcccacctcagcctcctgagtagctgggactacaggcatgagccaccaggcctggctaattttttttctgttttattatattttgccattctgcaccttcatgaaataatttttgttgttgtttttgtttttgttcgtagatacagtgtcttcctatgttgcc

SEQ ID NO: 9523 - DNA, 568 bp, Homo sapiens
gtccagctgatggaattttaggagactgcttgagaacattagttggaaacataaaggagtacactaggaagtgtctctggattccacagtcaccgggagccagggtgccctgtttgacttccgcctccgtaacactgtgttttgcactctccccactctgctttatataccagtgtctcccagcctgggctgcatcttctgaggtgactctcaaaaactttttaaagttactgacgacttggtctcaccttcagagattctggttcaatgggtctgggcgggtctgggcattagtatttcttaagagcccgccaggtggttctaatgtgcagctgggttgaaatccgaactttgtagttcttgggacttctttaccacctaaccgagtggccagtcttccggaaccagaggagcgcgtcactccgcagattctcccaagtggatcaacttgggatcacttcagctcctgcatagatgacaagactatgaaagtagaaactaggcctggcgcggtggctcacgcctgtaatcccagcactttgggaggctgaagtgggcggatcacctg

SEQ ID NO: 9524 - DNA, 458 bp, Homo sapiens
ggcacgaggccacatgggagcagtccatgcatgacagcctctatcctacaaggcctatgagtatggattgggggggccaaaaggaaaaagctccatgtgcctctttgtctgcgtgggtcagaagaattgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagt

SEQ ID NO: 9525 - DNA, 597 bp, Homo sapiens
acaggtagaggccactttggtaccattgtattccccaatccaacccaaccactatacatacacacacatacacacacacgtgcacacacacacacacacacacacacatcaattgttaacaaggacaattttagagtataaccaattagtaaagatataattttactaagtagaacagggacctaaaatacaataataacagaaatagaaagcaaaaaacaaaagtaaacctcaacaattattacttatggacccaagcactctgcttaccattttacaaacatatctcacatgttctttacaacattctcacaagggcaatatttatatccttaatttacagaagaggaaagtgagacttagagaagaaaagcaattttccaatgtcaaatttctgcttgtggcaaagccaaattaaaacttaaatattattaggccaggcgcggtggctcatgcctgtaatcccagaactttggggggccgaggtgggtggatcatgaggtcaggagatcgagaccatcctggctaacacggagaaatgccgtctctactaaaaatacaaaaaattagctgggcatggtggcgggtgcctatagt

SEQ ID NO: 9526 - DNA, 80 bp, Homo sapiens
caggttctgtcctgggccctggaaggtaaaggtaaagaaaaggaagatggctgggcttggtggctcacacttgtagtttc

SEQ ID NO: 9527 - DNA, 105 bp, Homo sapiens
gtttttacagattgattttgttgttaagtttcattttctcttttttaagtgctttttttggataactgttaatagctacttagttggttattaagtaaagttaaa

SEQ ID NO: 9528 - DNA, 248 bp, Homo sapiens
ggagtgtctacataaatcatttggaattcttctaaacacacttgtctgtcctctgccatttatttatgcggaattattattattattattatcattattattcagaggtagatatattcttgaaggaatgattatttaaaaaatcacagcatcccaatactttggttcccaaagaaatagatatgttcacattatgattaaagactgtttttgaacttgctctaaaaaatatatggtttctacattgc

SEQ ID NO: 9529 - DNA, 151 bp, Homo sapiens
gacttgggctgaggagccgccgcgtcccctcgccgagtcccctcgccagattccctccgtcgccgccaagatgatgtgcggggcgccctccgccacgcagccggccaccgccgagacccagcacatcgtcgaccaggtgaggtcccagctt

SEQ ID NO: 9530 - DNA, 464 bp, Homo sapiens
ggcacgaggttgccatactcttgcatacacaatcggttatctagtttttgattgtttgtgtgtatggtgtgtgctgtctctctgaccagatttcaggttcctgaggcgagcctgcagctcatactgctcatctgtcctctcctgtggtgggtgctcagggcctctcactgttagttactccctcctttctgcccagttctgcactcaactagtagaagcagccatcctttccccaagcaggaaattgtagtggtcgcccttaagagcagtgtgagggcagaagattaagggaggggaagagtccctggaactggaagaaggtaaatactttgccttgagagggcgccgaatcattttaccaaaatagtaaatggaaaaagtgtcaaaggttgggactagttttaaaaacacatatagccagtagacacatgggggctgtttaaataaaaacatttttttacccg

SEQ ID NO: 9531 - DNA, 375 bp, Homo sapiens
gagagttgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttaaacagt

SEQ ID NO: 9532 - DNA, 135 bp, Homo sapiens
ggacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaa

SEQ ID NO: 9533 - DNA, 178 bp, Homo sapiens
ctacgcttgctgtttgcgctctctgaaagggacaccaaggctgtgatttacaccaactgtcgagcactgcttctccatggagaaactagaaaaactgcttttggaattatctctacagtgaagaaacctcggccatcacaaggagatgaacattgtcttccagcttccatgaaagact

SEQ ID NO: 9534 - DNA, 366 bp, Homo sapiens
accaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaa

SEQ ID NO: 9535 - DNA, 414 bp, Homo sapiens
ggcgttggtgtcgaaaccgttgagtttctaaatatttatttattctaacaaaaagcaatgagtacggggggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatg

SEQ ID NO: 9536 - DNA, 433 bp, Homo sapiens
tctctctcagctagaaggttaggcattgcaaataccagtggatagggtttttcttagctttaaccccagcccatttcaaccccctctttgccctttgtatattcttttgaaaatatgatccagtagtgtttatgaatgtgtgttgtgtaaaatttagagattgatgttaaacaacagaattaaaggacaaagctgtcttttttgttggaattggggatgggagagcagctcaaagtgggaaatatggagaaaggagagacattgtggaaaagaagagataaattgaggggaaaaaaagaggatgaaaaaatgaagagagagaattactgatgtgcttcacacccacacctcctctccaacttcacagtaacagaggcaatgtcactatcttttacctgacaagtgctttaccagggagttgtgcctggcatcg

SEQ ID NO: 9537 - DNA, 369 bp, Homo sapiens
  misc_feature 90, 118: n = A,T,C or G
tggccaacttttatctgacattcttgctacaagtaaatatgaagaggattactacgaggatgatgaggaagatgaccctgatgccctganagatcctctctatcagattgatctgcangcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactga

SEQ ID NO: 9538 - DNA, 397 bp, Homo sapiens
gcagcacctgctcaggaagttggtgggcttcgctgggcgcacacggcccacctggcactcaccagcctccgggctgcccttggcaggtgccgtccacactccagcactcagggaggggcggtgcacatcctcaaaaactgaccacactggcactggcgcccaggtggtgagtaggcgggctgtggtctgcagacagaagctttaccctgtgcacatacgaggagtaactcatttgagtgacgtcactggactgcggcccttagagcctcctgacgcggaggtgggcctttcacttctgccttttgcatgtgtgaatgtgtgtgtgtgtgtgattttagagatactgttttaaaactgcgtactcaaagcattagttaattaactaggaagtatcgtc

SEQ ID NO: 9539 - DNA, 346 bp, Homo sapiens
tatctgaagtttttttttttttagttgcagtttaggcttccagagccgtatcagtctttatataaatctgttgaataatcgtttcttctaaaatcaaagtaaatttcttgtccatgtttaaggagggaaaaggaatttgggtatatgtaattttgctagtacttatggcttcaatctaaaaatgtttatgatggaccaggcacgggggcttatgcctgtgatcctaccactttgggagacccaggcgggcggatggctcattgagcacaggagttcaagaccagcctgggcaacatggcaaaccccgtttttaccaaaaatccaaaaattacctgggcatgggggg

SEQ ID NO: 9540 - DNA, 451 bp, Homo sapiens
  misc_feature 181, 183, 369, 419, 451: n = A,T,C or G
gtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggcgncncctatcgcggcgcccctggcccttgcctcctggcctgctatcctggcggcgcgcccccctgtctcccccacgcgcttcgccctggtggtacccggaggatttcactcgaacgtcctccacggcctgttgccgccttgtccctttcgcggcctccctttctcctggggcccattctgccggagaatngactatctctcccccctgacactagcttccgtcactccctgaccccgcancctatctcttcctcccaccggggccccccacn

SEQ ID NO: 9541 - DNA, 426 bp, Homo sapiens
ggcacgaggcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctgggctg

SEQ ID NO: 9542 - DNA, 428 bp, Homo sapiens
gatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatga

SEQ ID NO: 9543 - DNA, 424 bp, Homo sapiens
aacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaac

SEQ ID NO: 9544 - DNA, 566 bp, Homo sapiens
cccaaagtgctgggattacaggcatgagccaccgcacctggcccttgaacactgtatctaaggataaacagtcttattcacatcagagggggcagaatactaactgactaatttgtggaaatactggagctaaacatagtgcctaacacctcctatgtgtatgaattcccaagtctgaacagggcacaagtgaggagagagaaagggaggggaggaaagagaaagggccaggtgcagggaggagataaacacagacacagagaaagacagagaatggcttatcaaattaaaataagaagaataattataatagttacaatttattaaggtggtcttgtgtatcaggtattttatatataatgttttgtttaatactcacaaaaccctctaagatagaaattattactccagatgagaaaactgagattcagaacagttcatgacaaattcaacagggtctatggctgaaatgggattcagtgtgactccaaacccatgtttttccaaagaggccatactacctcccatgaacacaggtcagacaaacaaacagaaattctcagctg

SEQ ID NO: 9545 - DNA, 453 bp, Homo sapiens
tattcaataaactacataagatattgaaaactttgttataaaataggctttgtgttaacataggctttacccatctgtatgttagtgtaagtgttctgagcatgtataagttaggctaagctaagctatgatgttcaattcattaggtatattttatacatttcaacttacaatattttcagccagcaacatgtttattggaacatagccccattgtaaattaagaagtatctgtataggtacataaagtgaattcagaaatcatgggaatgttagttttgtatgtgtgttagtgtgtgcatgcacaatgcatgtgtgggtttaaaagaaaattgagggttctaagataaatataacaaggatttataagacttaacagtgagaaaaaataattacaaaatttccaattttaaaaaaattgggctaggcatggtcgctcactcttgtaatccc

SEQ ID NO: 9546 - DNA, 348 bp, Homo sapiens
aatgctcactattccccctccttggttttggattttaagtcattggaagatggtccccaatccaaagttataaagggattcattcatatttcttctggttctcttatgattttaatgtttacatctaaatcttgggcccatttggaatttgtttttgtgttctggcgaacagattcagttttatttgtttccaggtggtttcctggttttaccaacaccatttattaaaaagcccatgcttacctcactgatgtaaggccctctttatcatatgctaaattccactatgttttggtgtacattttggggctttgtttcctgttccattgacctgtctactcatatgtg

SEQ ID NO: 9547 - DNA, 582 bp, Homo sapiens
gtatatattcaagcaactaagactcactctgacagttgtttactacatcagagtaattccattcatagggataaggatcctactgcatagaaaaactttaaccaaaggccaggcacggaggctcacgcctgtaatcccagcactttgggaggctgaggcaggtagatcacctggtcaggagttcgagaccagcctgaccaatatgatgaaaccctgtctctactaaaaatacaaaaattagccagacgtggtggcatgcgcctgtaatcccagctacgtgggaggctgagacaagagaatcacttgaacctggaaggtggaggttacagtgagccaagatggtgccattgcactccagcctgggctacaagaacaaaactctgtctcaaaaaacaaacaaaaactttaactaaacatcatgtctctcaaaacaatgctgcaatactgactcagagaagttttaatgcttggggccagtaatctctgttaccttggcctgactattcttacctggtctactgcagagccaatggaacgagttttctttacaggtccagggggaccatcaacaaactgtcggct

SEQ ID NO: 9548 - DNA, 446 bp, Homo sapiens
cgacagaaggggtgtgtatatataaatgcaaaaatagatgtgacttgccactggtctgtgggactcaaaacaatccacctgtttggaaatgtctgttgctgctattgtagaagtttctttacgatataatttgtttgttgcttggtgctgggctacaagaatgtaagcatttttttttgagatggagtttcactcttgttgcccaggctggagtccaatggcatgatctcagctcactgcaacctctgcctcctgggttcaagcgattctcctgcttcagtttcacaagtagctgggattacaggcatgtgccaccatacccagctaatttttattagcaaagacagggtttcaccatgttggccaggctggtcttgaactcctgacctcagatgatccgcctgcctcaacctcccatagtgctgggattacaggcatgagccact

SEQ ID NO: 9549 - DNA, 500 bp, Homo sapiens
ctttaaggctaacagcctaatatgccaaacaaatgtatactgtcaggccatttacctggcgatgccggagccctctgggcacatgcatatatttatatcagtacatgagatacatgctgaaatgttattgcctacacgctttaactctttactctcaaaattcagttcttgaatgtaaaataaaaagaccttacaattctgctttattaaaggcttacttcctgaaggcagaaatcagacaaggaaagttaagaactgttgtaatcacaaaaaattaccttcttcaatattactacaaatacattgttgtcctattcaccatcaataaagaaactacaaagcatacaacatttttaaagaggagggtgtctgtaacaggtcttctaaccctgtcattcattcctttttctactattccatgttgctacagccttcctgtttccctttttatcaacattttatttaaaaatttttcaaaaatataacaaagtttaaagaat

SEQ ID NO: 9550 - DNA, 413 bp, Homo sapiens
ttgaagcgattctcctgcctcagcctcctgggtagctgggattacaggcgtgcgccaccatgcctggctaatttttgtatttttactagaggcagagtttcaccatgttggccaggctggtctcaaatggacctcaagtgatctgcctgcctcagactcccaaaatgctgggattacaggcgtgagccaccgcgcccagccacccatgccctctactaaacagctcttggagatggtagaattacggtgctggaaaggaccttggttcaactttgtcattttagcaataaggaaatgggggactagaggtggtaggatcagccctcattatataatcgcccatacatcgtaatctttactgtttaaatgagtaaaggcaaatataaagaaagtaatttttttttttttttttt

SEQ ID NO: 9551 - DNA, 602 bp, Homo sapiens
aatgtacatcttatagctaccaagacttgctgctggtgtgaatgttcaggtaaaagagagagaaatcaagaatggctctaggctgggtgcagtgactcatgcctgtaatctcagtactttgggaaccgaggcggatggatcacttgagctcaagagttcgagaccaaccagtctgggcaacacagcaagactctgtctctccacccctcaaaaaaagaaaaaaggaaaggcatgactctgagggtaaattctaggaaggcatgtggggtgggaaatggggccagcggtgtgattaaagaatgtacatggtagtagagggatgcagatctagataatattgaaaggccaggacttggacttctgggaatgggaaacatgatagaattatctgtaattttccagaatcaatgactagttgtttttttaaaaaaagaattatctgtaattgtgttttttgagacggagtctcactctctcgcccaggctggagtgcagtggtgtgatctcaggtcactgcaacctccacctcccaggctcaagcgattctcctgcctcagcctcctgagtagctgggactacaggtgcccgccactatgcccggc

SEQ ID NO: 9552 - DNA, 340 bp, Homo sapiens
aggctgagggaggagaattgcttgaacccaggaggcggaggctgtggtgagtcaaactcctgccattgcactctggcctgggcaacaagagcaaaactctgtctaaaaaaataagataaaataaaataaggatggcgggtagatataaaggagcacgtggatattcagtggacacaaaaggcttgtcataccatggtagaagagtgtgatccaaacctttccctcatactctgaattctgtagccatgtcccacttctgtcacctcctgtatgatctatgcttacacacatgattttgatgagagcacattgaagtgcccccaaccactcacacttaaca

SEQ ID NO: 9553 - DNA, 324 bp, Homo sapiens
ctgccagagtcaccacttgctgagtgattaggcctccgagaaagcaaggcggctgggggacatgcgaacacgacgagttcggctgtgcctgccttctcctcactgcccaggtgtgttctgcggccaagcgtccgagtgctcttatcttcagtgcctatcatgcacatacgtaacccacaaatactgactgaattagaattagggttattagggttatgacttagggaaatctttcaatgtccttggcttctatctcctcatttgtcagatgaaactgaaatacaagcaatgccttataaatttgttgtaatggggccatgcatg

SEQ ID NO: 9554 - DNA, 331 bp, Homo sapiens
aataatggcctgttaaagacccagatgtgtgcactgtctcaggttggctctttaagttcctggactaagaatctccataaagccatacaaactttaaatgagtcacccactagcacacatggcatcactccttataaatggttggcaaggcctgtaagacatgtcccacaaactctcggggttacctcaaagacactgagccatgctcctgaggcagatggtgagacatgctcctgagaacaccagtggatctgccaagcagtgatggctacagggacctgaagctgagctggaatatgcctccatactggattagttttatagtactgga

SEQ ID NO: 9555 - DNA, 266 bp, Homo sapiens
tttagtagagacagggtttcaccgcattagccaagatggtctcgatctcctgacctcgtgatccacccgcctcagcctcccaaagtgctgggattacaggcgtgagccactgcgcccggcctcaggtttcccctttcaacccacaagggaggtccctaagaatatggccccaggctggccgcatcaaagaaggcttgggtaggaactgttacaagtctgactctccccctcaaagaccttattagcactgggcgtggtggctcacg

SEQ ID NO: 9556 - DNA, 396 bp, Homo sapiens
agaagatagattttttttaaagatttatgaactgcgagtttggaaaagcacatttaattctagcatgtgaaattgttcgatttattttcccaggatctttgtcagttggttaatgctgatgctccttattggctagtgggcatgacagaaatgactcggacgtttggcctcgaattacttgagtcagtcctcaatgattttccgcaggtctttttacaagtaagccatttatagtatcttgtgacaaagttaatctgaattgttttacagatatttttaaagaaagcaacgtgtattttttttccaccttaaaagtggcaaagaggccagagttggtggttcatgcctgtaattgcaacactttgggaggctgaggtgggaggattgcttgagccc

SEQ ID NO: 9557 - DNA, 544 bp, Homo sapiens
ttggggacagcctcctagagaaggtcgttgagctggtcttcatggatagaggagtggcatctagaaaggaaggagggatgcaccctcatcccaggcagaggaaggaggaaaggacaggagggaattgtaagagggaaagaaccatagctatttctaagtgaccagagcaaaaggtgggcagtgacaatagcaacagagaagactgagagctagaaggacccagtgtccggttttgttttgttttttaaattaaaaaaaaaaagtttttgggggccaagtgcggtggctcacgactgtaatcccagcactttgggaggccaaggcaggcagatcacctgaggttaggagttcaagaacagcctggccaacatggtgaaaccccatctctactataaatacaaaaattggctgggtgcagtggctcacacttgtaattccagcactttgggaggccgaggcgggtggatcacctgaggtcaggagtttgagaccagcctgaccaacatggagaaaccccatctctactaaaaatacaaaattagct

SEQ ID NO: 9558 - DNA, 414 bp, Homo sapiens
aatgtgtaatctgctgctgttgagtagagagttctaggaatgtttattagttcctttgggttgatggtggccgattcttccataaccttacagatgttatgtctcccagttctactgattactgacagaacagtgtccttgactgtatattgactatatttatatatacagactcttctattattattgtggattaaaataattttgtagccgggcgcggtgactcacacctgtaatcccagcactttgggaggcctgaggcaggtgatcacgagatcaggagattgagatcatcctggctaacacagtgaaaccatgtctccactaaaaacacaaaaaattagctgggcgtggtggcacgtgcctgtaatcccagttactcgggaggctgaggcaggagaatcacttgaacct

SEQ ID NO: 9559 - DNA, 76 bp, Homo sapiens
tagaattccaagggaataaaagaggaaccaacatttgtagattttgccttctgtggcggaactcattcaatcttca

SEQ ID NO: 9560 - DNA, 551 bp, Homo sapiens
tttcccacagtggtaaaatcttactctaaaaaaaagctaaatttagaataattacaatgatatgcatgttaagtcacttaggtataatctacacagcattaaaaaagatctttggggaaagttcaagaaaaatctctgaaaattaataatgtgtgatgtttttgctaaacattttaacagactgatattccacgccattgtgagttaatttatatcctgagcaccaaaaatgttgtcattgtaataaatgatgtgtactctgtaggacaatataaccacagtgttcagtggaattaatagcagcgtttgtacaacgtgtgaaaaagagaaaggaaagtgaaagctctgtagcctttattcatagaaaggcaatttttaaaaatcacccagaaatgtgcagccttgtgcatctattgtttaatccaacactctaccaaaaatagttacacagtgccaggccctatgcttggggctgggaatgtagcacatagaacacagttctttccgaactgcaggtagccgtgaagtcaattaaagagtcatcattggca

SEQ ID NO: 9561 - DNA, 589 bp, Homo sapiens
agttacttgctttttaaatagctcaaaagtttttcatccttttaaccaaagttgccaaatctaaagcattattccttttggtcatcaagtagaggaatggatgaatatatttcagtttgcttattactaaaatatgttagtaatagcatattttattcaaatcactgcataatagctctgtcttattttccattttcatgacaaacacacccaaagctcagctcactgtatttactttcttttcatgatactgtttgctaagttttttctgtttgcttcaccatattttgaacaattttctattaaactaggatattttaaaagtttgccttttcaggccgggtgtggtggctcacgcctgtaatcccagcactttgggaggccgaggcaggcggatcacgaggtcaggagatcgagaccatcctggctatcgagaccatcctggctaacacggtgaaacctcgtctctactaaaaaaaatacaaaaaattagccgggcatggtggcaggtgcctatagtcccagctactcggaggctgaggcaggagaatggcgtgaaccctggaggcggagcttgcggtgagccgag

SEQ ID NO: 9562 - DNA, 513 bp, Homo sapiens
tctctggctgactttttggcaggcccctttgccattacttgagtgcctcagtttccctgctcttacgttagactagtgcgtcaaagccagtgtccctaggggcagggaaagagaaaagacattagctcgctaagtttaacagctgattcttgtatcttccagctgtctacgtttgttttcaaaacattcaatgagtcacagcaactcagagagggtttatgacagtttgccatttttaggagaactgtataacccaaatgatgaaggtcagatttgaaggagttggatctctaataggaatctgaagttttttttcttactgtcatgaagaaaggtcctgataacaggatggtaggattaggatttagatccagcccagtgtcggggtgaacagtgactaaaatgtgattccccaagagagcctcggcgatgacagtttctggtcctggagtctatgggttaacccctgtagcattagcccccgtcacagtgacatcagaataagaacaggct

SEQ ID NO: 9563 - DNA, 559 bp, Homo sapiens
aaccgtaagtacccaggtgtgtgctgcgttgctctgcccgtctgggatggttttcagcaccgctgctttgtgggagttgagtaagggaaaataaagagccaaaataaagccaagtctgagagtagcccccagaagcatgcactgtggagtcctgaggctgtagagaggccgtcacccagctttcaaggagccacattaaaacaagcttttggaaggtgatttgtcactgtttctcgagaacttttctgtttggcttagaaactccactttggggatttaagggaagaaagagaatttggacaaaagcaagagaaaagatatttatcggctgggcacggtggctcacgcctgtaatcccagcactttgggagtccgaggcgggcagatcacgaggtcaggagatcgagaccatcctggctaacacggtgaaaccccgtcaccactaaaaatacaaaaaaaaaattagctgggcgtggtggcgggtgcctatagtcccagctacttgggaggctgaggcaggagaatggcatgaacccgggaggcggagcttgcagtgagc

SEQ ID NO: 9564 - DNA, 437 bp, Homo sapiens
caactctgaaggcattcctgttttaatcaagctagcacacttttactagcttatatttactgaaatttatgccagataacatgaaaccgtgaaaaacattataggttactttctatctttctaagtgtgtaaaaaatattttacataagtgtttctttttctttaagcctattaaataaaaaattttacaatttaattttggcaataccatgagtagtatagggaaatatcacatacacataacataatacagacatatgtaaacatacaaactcaaacagatcttatagattttatttaaatattttagccatgtgacaggcataatgacacaaagctcactaatgcattaaagaatatctagagctaatttttttttctggccatgccaatgaagcaagattacttaccttgatggttaaagcttttgactactg

SEQ ID NO: 9565 - DNA, 63 bp, Homo sapiens
ctgggaaaggaacataattgtgatggggtgtgtgtgtgtgtgtgtgtgtgtgtgtgtgtgtgt

SEQ ID NO: 9566 - DNA, 320 bp, Homo sapiens
cttgtggcccttttccatctcttctgggagctgcctttattctgagccagctctacacttaaaggggcgtttgttctattttatcccgaattcctaaatgttttgtggagacggaaggctttttaagatatctagtctaccatatctccaggaataaaaatgatttctataaatttttaaaacctatgtaaagttaaaagtaaattaaaattgaaaacaattatatttgttcattccctatctgttcttgcatgaaatgtattgacacgaggatgccacatcatggaaagagaattctttgcatatgaaagcattaggag

SEQ ID NO: 9567 - DNA, 603 bp, Homo sapiens
agccagccacctagctacccttgactactgttcatttctgaaacttgtttctctagaacttttgttcattcttaaagcgaaccaagatatttcaaatacatgaatttttttacttaagttagctaaagtcatatttggtagttttcaccatgaaatctatggtctgccaccccaggtcttccataaggcaacccacatggtcctaccttctgtggagcacagtcattgctgcattctgaaagcccctgggttaaacagatgtttctcgagagcagctgatatcagctaggtaaggagcatcaccatcatataattaacaagatgtgcatgtatcttaacagtcaattttaattttcaaatcagagcctactaacacaaaagaatctcccttggaaagaatatacacatacatataactagctagctagatagacagacaatcagactgattgattattcattcaacatttattgtgttcttattatggaccaaacttcttaggtcttaggcataaaaagacaaagaagataccacccctccctttcaggagctcacaatcttggtaagagactgaaatgtgatcgggttatggcaataacttt

SEQ ID NO: 9568 - DNA, 346 bp, Homo sapiens
gtgatatgccagatgttacaacaccaaatgggttgccattcaattctggatttaagctaaatgaactggttgactaactggattgatttgtcattagacttacatgtttctaacttcttaaaagcatactttaattttcatctcccttatatgccattgtgtgaatactgggtaactctctacattgtaagcagattttaagaaatctgcatttaagagatttttgttcaaaagtagatttaattcacaaaagcctatatagtttgtcgttattgctatatgatttttccaggcagacctgtgtaaaaataatttcaggcagtgggaagagcatgtgcaaaatcag

SEQ ID NO: 9569 - DNA, 536 bp, Homo sapiens
aattgaaataaaatataaaatcatttaaatgtttaaccatgttaaagggagcatcatgacccagagcgttattcttagaagttgccagccttataaagacccatcagggtaagcaagtctagggacaagcagttaaaaatgaagcacttctaactatgtacctcaaggtgaaatagattttatagaaaaagccatatatgataaaaatctaaactttcagaactagatgactttgatggatggctttacaaaatgatagctaatataacataattcaaaatcaaatgagtttttaaaatagagcatctgggccgggcgcggtggctcatgcctgtaatcccagcactttgggaggccgaggtgggcggatcacgaggtcaggagatcgagaccatcctggccaacacgctgaaaccccgtctctactaaagatacaaaaaattagccaggcgtggcagtgggcacctgttgtcccatctactagggaggctgaggcaggagaatgacgtgaacccgggaggtggagcttgcagtga

SEQ ID NO: 9570 - DNA, 544 bp, Homo sapiens
ggctgaggcaggagaattacttgaacccaggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactaattaataggaattaattaatgaatgccaaggggcagagccacacttcctatgatagttccttgctataaggtgctattttgttctctacatttactccatagtaagcttttgtttgagaaaaaaaatgccagtttggtgcgtagtagatacgcagaggctgagaaaggaacagatgacacaataacacaatggtaacagaatgtataatgcttccctctcaacttggttgatttgttttttttacatttacttggaccaaacaagcaaaaatacatgctccccagaagaacagaaataaggattttctttgggaggtggaggcgggcggatcacctgacattag

SEQ ID NO: 9571 - DNA, 466 bp, Homo sapiens
aaggatttcactatgactttatctcccaggatatttaaggtttggtctcattctctaaatgtacttaaaacaagaccgttggacttacattttgttaacataacaaaaatgtatttatcatttcagagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggtgaatatcttttgtgtaaagaaaaagagaaccctgagttagaaaaataggactgtaatgacatgggtcttttcagcagtcaaactacaaacgatgagagaaaactgtatgccct

SEQ ID NO: 9572 - DNA, 401 bp, Homo sapiens
tagaggattacaggcgtgagccactgtgcccagctgttttacatcatttttttaaaaaaattattttttatttttttgagacagggtcttgctggtgcctaggctgcagtgcagtggcacgatcatggttcaaggcagtctcaacttcctgggctcaagtgatcctcctgccttggcctcccaaagtgctgagattacaggtgtgagccactgtacccagtctgttttacatcatttttaatggctgacttttccagttgtaactgcaccataagttatttatttaatgtctttactggtggacatttttactattttcagttttttcctacacttatcaatgaacttcattgtggatacatcttgtagactcatcgcttctttttttttttttgaaaaaa

SEQ ID NO: 9573 - DNA, 466 bp, Homo sapiens
gaggtcgaggctgtagtaagccatgattgcaccactgcacaccagcctgggtctcagaacaaaaaaaaagagagaaaatgcaattatcgtccccagataagaaggattacctttgtcacaactgcgaagtaattgctttggtacggaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggtcaaggagggtggatcacctgaggtcaggagtttgagaccagcct

SEQ ID NO: 9574 - DNA, 198 bp, Homo sapiens
ttgtttgagcttctttaagatagctgttttaaagtgtttagtaagtctgctaactgatctttcccaggaacagtttctgctggtttatttattgatttttgaataggctattcttccctgtttctttgtatagtttgtgatgttttgtcaaaaactaaacatttgaggccaggggcagtggctcatgcctgtaatccc

SEQ ID NO: 9575 - DNA, 576 bp, Homo sapiens
caccaccacacccggctaattttttgtagtttagtagagacgggttttcactgtgttagccaggatggtctccatctcctgacctggtgatccacccacctcggcctcccaaagtgctgggattacaggcatgagccaccgcgcccggccaaaattcacggtggtttttatctgagatgtccgcatcacacatttcctcactgctcttgaggttccactgacaatcagaagaatttcaatttttacattaattttgttttgttactgctttggggaggcaactggagatgattcaacatttattaaatcaactctttgggattaatgggtgttctcttcttctgaaatacaatgttctgttctgttttcatgaggctccaattgaaaactcattcctgcccctgtcctcatttccctccctgggtctgtgaacagctttctgaagagacagagagaagtgagctagctctgggagtaggcagtggaagagcactacagtgctttccatacctagctgaaaaggacctgtagaaaatctgcagacacatttatgatcagggacttctttcccttcct

SEQ ID NO: 9576 - DNA, 183 bp, Homo sapiens
agagtggtgatggatgcacagctttgtgactatactaaccaccactgaattgtacactttaaagtggtgacctttatggtatgtgaattgtacctcaataaggctattattagaaaaaagccactaaagtttttagacataataataatatataacttgtatgtttcttgattcaaataaacc

SEQ ID NO: 9577 - DNA, 445 bp, Homo sapiens
aagtgctgggattacaggcgcccaccaccacacccagctaatttttgtatgaaaggtaattttttttaaagccagaaaacacagaagtgaaaatctctttccagtccaggcaaaagaagggcatgtattcacacattcattcattttggtagagcgttggtcacgggcacagacccagctgccccactgcttattagccccatcgtttcccagctaggtgacctttctgccttggtttccccacctataaagggggatagtaacagtacacctatcctctagtcaattccagtgaaatgctcagaacagcatctggcatgtggttcttgctcaattcatggtatcttttactcggaccacaacttctaaagcttaaaattaggttagataataagaaacatccagaatgaggccaaaatgaaaccagggctgtcctggaaaatct

SEQ ID NO: 9578 - DNA, 567 bp, Homo sapiens
tcccatcgccacaaatgcaatatgtttggaactaaactcatcatctggccatctgtttcattcctggttttgtttactagttttaacgcctctcttacttgctcatcctgtcctcctttgcctgcagtttaggaatactaccactaggtggccatattgggttatactttcttgcattctaagccagaagctggctttcacaaatattcaagatggtgggtgggccacctcagagtttcacccaaatttttagcaaaaagaaaacatgatagttttttttagtgtaaacattttatgccctaataaaatccttaaatatcataaactttctaaactcatttttaaggataattttgtgggccaggtgcagtagctcatgcctgtaatcccagcactttgggaggtcgaggtgggtggatcacttgaggtcaggagttcacgaccagcctggccaacgtggtgaaacccccgtctctactaaaaatacaaaaattagttaggtgtgatggcgcacacctttaatcccggctactccggaggctgaggcaggagaaccgcttgaaccca

SEQ ID NO: 9579 - DNA, 261 bp, Homo sapiens
ttgaaaggcaaggtaagaggattgcttgagcttgagtctgaggccgcagtgagctatgaccacaccactgcaccccagtctgggtgacagcgcaagaccccaactccaaaaagaaaaaagaaaaatcacaaagaattgcatggcagagtgcctgtctttcacagctttaactgctgaaggaactttctttttttttttttttttaaaggggggggagaaaacaaatttttggtaaggaattttttgccccaaccccccaaa

SEQ ID NO: 9580 - DNA, 285 bp, Homo sapiens
tgtttttgatttcatgcctagatcttttggttttaattcacataaaatagatgacacatgttttctgtgttcactggaattttttaaatcaacaggataatatatattctgtgaaaataaaataaaagcaatgacaatgataatatctcatgtgttttagagttcttcaagggttttcacatgaattacattatcatgattgattttcatttaaaacatgaaaacaaaaacctgtgaggtaggcagggttaaggaaaaaatttaaaaagctccattgtgtataat

SEQ ID NO: 9581 - DNA, 593 bp, Homo sapiens
ttgaactcctgaccttgtgatccgcccacctcggcctcccaaagtgctgggattacaggtgtgagccaccgcacccagcctgccaattattacttctaaaattcttcctaaagggtggccaaattagttttcactgacttctgtttaaaaattcaataagactctgaactaaagactttgagtgaagagaaatgatacattgtacatttaaaacctgtgtcttttagacatacagccaaaaagcatatgaaaaagtgctcagtatcactaatcattagagaaatgaaaattggaaccacaatgaaataccatctcacacaagtcagaatggctattatatgaaaaagtcaaaaaacatgctggtgaggttttggagaaaagagaatgcttatacactgctggtgggagtgtaaattagttcagccattgtggaaagcaatgtggcgatttctgaaagaacttgaaacagaattaccattcaacccagcaatcccattattggctgtatacccaaagggatataaattgttctgctctaaagatacatacacacgtatgttcatcacaacactattcacaatagaaaagacata

SEQ ID NO: 9582 - DNA, 564 bp, Homo sapiens
aaagtcatcataacttccttcactcagtttctgtcttcttccagtcagggatctagtagcttgactattcttcattggttccctttcatttacaggtcacccaacaagacaaaccacacaggtaatctcttctgatccctgccatcgccaagagtcatttcctgccctcatcactttctaaattctatccaattcccagaatatccatgctccttctcactgtccctcattcacataatgcctaaaacactattcctgctctttgcctgatgagcccttactcacttgtcaagactcagatcaaattgtcaagactcagatcaaattgtcacctcttctgggagggcttcctcaacctctctaagtggagttaatcatctctgctcccacagtgtatttttttgttctctgttagtgattttcttatttaactgtctagctccatttctacattggtagtcctgggatggcagattttagtcatcttagtatcactacctggagcctggtctatacttgatgtttaagaaatataagtctgggtgcgggtgcagtgactcattc

SEQ ID NO: 9583 - DNA, 453 bp, Homo sapiens
aagttagaagactgagtaagaggtcgaaagggatgggagttatgtgtagggactgaaaacaggtttgggagagcttaatgtttgcttttatactatgactcttcatgttttctcttcaaccatcctaaagaagtctgataatggaaaggcactcgctctgcagtggccaggacaaactttgtacaaaatctgtcatatgatgaggagtaggaaatgaaagaaacggataggaaatattcaggaaaatggagtataagaagtgtgatccagttatgggagggcactggagaatttacaagcattacagtgggaagttttattccttagtggaattgcaagtaacatagtgccttaagaaatttgaatcatttagcttatgtacttaatctgagtcatttctgacaatgttatctaacttcctcttcccccaattcaatttaaaaaccacacatt

SEQ ID NO: 9584 - DNA, 312 bp, Homo sapiens
tctaattatttgccttttaaaaattacaatctggccgggcacagtggctcactcctgtaatcccagcactttgggaggctgaggcgggtggatcacctgaggtcaggagtttgagacagcctggccaatgtggtaaaactctgtttctactaaaaataaaaaattagttgggcgtggtggcgggcgcctgtaatcctagctactcgggaggctgcggcataagaatcacttgaacctgggaggcggaggttgcagcgagccgagatcatgccactgcactccagcctgggtgacagagtgggactttgcctc

SEQ ID NO: 9585 - DNA, 639 bp, Homo sapiens
ggcacgagcagcctcccaagtgttgggattacaggtgtgagacactgcgcctggctatattttactatttggaaatcacaatgcatcttaaaattgatggcttcttgcaaccactttcaaccaggtgcctgtcatgatttagtgctagcatcaaggcaggttagttatgaagaaatagagtgtgtgtttatatactcacacagttagaaatcgacccttttaaaaattatttctttttgaaaataatgtcagttccatcagaactaatgcattgataactaaatgtctgtggttccttgtcataggtctacacctgacctctctattttgtgcacataggggattcgtaatatcactgttcagtcagtcattcaccatctagtgatcatcattctacatgattgcactttttcaaaggcataaaaagccaacagttgcactcttaataatcaactgtaacacaaagcagagtactttgggagttttaacaggatatattattggtaactggctattatgccactccctctgggtgccacatttgcctgttaaccaagaaatgtagacatggtgccttatcccaacatttctgaaattatatctcaaggaatcaccagtgcttactagtacttgacaatg

SEQ ID NO: 9586 - DNA, 662 bp, Homo sapiens
ggcacgagatcacctccttcaaggacagagtgccctcacctagggccagggggaggttcagagccacactgctagccaatttgtttcaagaaaaattcttggtaggctgctgccagcagaagtgctgcctgttgaggcctgtcactgaatggtaaagatctgtggccaagaaccccaaagggccagattctaatccagatccatcactgcttgctgtgagacctcgggcaagattcttagcttctctgtgcttcactttcctcgtctgcgaagtctgtatgcacagcacaaagtggttgggaagactggtgggattccggcaggggtggagctctgcagactgagacactcagttggctgttactagtgggggctgccatctctaaatctgcacctggtattttcctgccttttctgcaaagcccccagggaaacagcctcagaactcctcaaacacctccctccccagatccctgttttccattccctactgccaaagacagcggagctatgaggttgtgccttgcctcggtccacggtgggctcctggatggctgggcactgatggggagctgcatgaataactgcctgggctgggggttgcccagtctcagggctgctgtgtagtctccaggctgtgttggtagcatcaactagcagct

SEQ ID NO: 9587 - DNA, 597 bp, Homo sapiens
ggcacgaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaggaaggatcaaacta

SEQ ID NO: 9588 - DNA, 526 bp, Homo sapiens
ggcacgagccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccct

SEQ ID NO: 9589 - DNA, 611 bp, Homo sapiens
ggcacgaggccgggcggaggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttccccca

SEQ ID NO: 9590 - DNA, 59 bp, Homo sapiens
ggcacgaggagagagagagagagagagagagagagagagagagagagagagagagagag

SEQ ID NO: 9591 - DNA, 607 bp, Homo sapiens
ggcacgagggaaagaaggaccagccccttgaccgttctggctggggaattgtccacgaggaagcctctgcacttccacacatggcacagttctgcctgtgacctgccgcctaagctttactggaattcaggttttgagactgagatgcgtgttcgtatttttccacttatctgtcttgtcagctggccgacttctctgtgattggttttttaagtgccgggtgaattttggacctctggatgtgcagcaagtttttatgcaataagccttcctttcaggtctctaaaagctcctgctctgatctgtggtttaacactgtgcagggctgtggagctctgagagacctgaacccctacccatcccctgcacctccctactctccctgccgaggcgtccatagcatttccctaataaatagttttatcagggacactccatggggtggcttgtctctgccccaaacagggtcttcacgttctaactgcagggaagagactggttactagcgtaaagctgacaagttaccagttcacctgatcagaatgtattttttataaccaccatcattccttgtctcttcagtggaagatattctttcctgtttccc

SEQ ID NO: 9592 - DNA, 630 bp, Homo sapiens
ggcacgagatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacaga

SEQ ID NO: 9593 - DNA, 553 bp, Homo sapiens
gactaagaatccttgtggacaggaaaagtggtgtttgtatttattatcctcctaacctaacctctggctcaatgcctgacacaaagtaagaattgtttcaattaattaaaaatgaaaactggctgggtgctgtggctcacgcctgtaatcccagcactttgggaggccgaggcaggtggatcacgaggtcaggagatcgagaccatcctggctaacacagtgaaaccccgtctctactaaaaatacaaaaaaattagctgggcgtggtggcgtgtgactgtagtcccaactgcttgggagtctgaggcaggaaaatggcgtgaacccaggaggcagagcttgcagtgagccgagatcacaccactgcactccagcctgggcgacaggcactccagcctgggtgacagagcgagactccgtctcaaaaaaacaaaaaagaaacaagaaatgaaaactcaagctaccaagatacttagaagtttcagagctttatgaagacataaaatgctaaaagtgaagtaagggtagaaaaggaatgcctaccaatgtggga

SEQ ID NO: 9594 - DNA, 555 bp, Homo sapiens
atttcttagcatatgctccctttttgatcttctgccaatgtttccatcttattatattaaatatgatatatgaatgtaatttaaattccatatacttgagcaaatatgagacaaaattccctttcatgttaatatttaatccaataaactatcacttgactttttgtaactatacatcatagaacatacatatctctcagttatatctcttaatctagttttttgggttaatgtatatatgtgaaaatttatattttaactcaaggtaaaagcaatatattaaacaagtatgggaaaatacatatgagaaaaagagtgcatttccttttaacaatgttggtcatgtaattaaaaactaatatgtaggaccgggcgcagtggctcacgcctgtaatcccagcactttgggaggctgaggcgggcggatcacgaggtcaggagatcgagaccatcctggctaacatcgtgaaaccccgtctctactaaaaatacaaaaaaattagccgggcatggtagtgggtgcctgtagtcccagccactcggtaggctgaggca

SEQ ID NO: 9595 - DNA, 359 bp, Homo sapiens
ccagaggagtcccccaccaacaattagcagaaccagtgccattttcaatacatcaagatcaacatcctacactgaacattcttagtgacccatagtctgggtgaaggtcattacactctcagggatttgaattagaacacaggtaaagctaaagaaagtgggagaagaacttggaattagaaaaagcccagttcaaagataatttgtattttactgacatgttcagcatagcatgaactctggctctgccgaacgtccagtctgcctcatgtacaaaagtttctgatccaggggccgggtgtggtggctcatgcctgtaatcccagcaatttgggaggccaagacaggcggattatgag

SEQ ID NO: 9596 - DNA, 53 bp, Homo sapiens
tctaatgtttaaatcccataaagctaagtttcccgttaaagggaagtgctttg

SEQ ID NO: 9597 - DNA, 639 bp, Homo sapiens
ggcacgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagc

SEQ ID NO: 9598 - DNA, 493 bp, Homo sapiens
gatttgagagtctcctcccattttctcactgagtaccctgtgatcattacactctttctctgctgcatccctgctgtctcagtgcattggtctgttactgagcagtgggcatatgaatctgttgatcccataacactcttggtcccctgctaagggtttgggcttaatgtcttccagggacaggagatgatgtcttgagtacaatgcaaggagttgtataaagctgggagcattaaagggctgaacctcagtgatagagtataccagaaaaatagtttattcccaagatctgggaaacaaaaggggagcttgtcagtttctgcttggcctatgagaggacagagaacctccttgggttatagtgactacagggtttacttgtggctttaatttatattacagatttttttttttgacagtgtcttgttctgtcacccaggctggagttgcaatggcgtgatctcctctcaccacaacctcctcctcctgggtt

SEQ ID NO: 9599 - DNA, 358 bp, Homo sapiens
cgttgctgtcggaagcgatgtgctcactgtgtgagcaagttcactgttgcctacagggctggaatggtagaagactcttgaagcttaactcattccccacaaggcatgcaattttttccccagtattttattgactggtttgatggttcaggcttcaggtctgtaggggagtgcataggaagtgattgtggccaaaacatgtgagtaaatgcaacacccaatggtgagcaaaggtcccatccttgacagaggtggctggaggagctctcagtgagttgcatcgagattttttttttttttttttaaaacaaagttggttttttgtgccccaggcgtgaatacaagtgcttaatctccg

SEQ ID NO: 9600 - DNA, 223 bp, Homo sapiens
acgacagaaggatacggctgcgagaagacgacagaaggatacggctgcgagaagacgacagaagggacctgaggtcgggagttcaagaccagcctgaccaacatggagaaaccccgtctctactaaaaataaaaaattagccgggcgtggtggtgcatgcctgtaatcccagctactggggaggctgaggcaggagaattgcttgaacccaggaggcggaggg

SEQ ID NO: 9601 - DNA, 321 bp, Homo sapiens
cgtctgctgtcgggccgcaggagttttttttttttttttttggttttcccaaaattttttggaaccaaacccaagtgggggggatcctgggggaaaaaaaaaacccgttttaaaagttttcaaaaacccttttaaaaaggttttttccccaaaatttttggggaaaccaaatttttttttaaactttttttaaaactttgggagaaggggggtgggaaaaaactaaacttttttccttttccaaaatttttttggccccccgaaaaaccgcaaaaaggcccttaaaagcggtttttttaaaaaagggattttttttttttt

SEQ ID NO: 9602 - DNA, 483 bp, Homo sapiens
ctcggcgtcgccccgcgtaccgtcgcccggctctccgccgctctcccgggggttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgag

SEQ ID NO: 9603 - DNA, 420 bp, Homo sapiens
gttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgaccccc

SEQ ID NO: 9604 - DNA, 262 bp, Homo sapiens
gcccaacatgttacttggccaaatgtttttgtgcagtgtaccccctgtacagctgtatgtgattggccaaccttatctcttatctcccatagcagccttaatgtctccttgttaactctcatctcacttaaagttacttgttgaatgtctctcattcttgctagagggtaaactccctcagatatggcatatacttgtcatatttattccaaggacataacagtgccaggtacctaatgggctttttatgatgtttattatt

SEQ ID NO: 9605 - DNA, 475 bp, Homo sapiens
ctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttctt

SEQ ID NO: 9606 - DNA, 393 bp, Homo sapiens
aaaatgagtaggagatgactgagagcttaaagtttgggagtgtcaattaactcagcattcttttaaaaaacgtgtcatatattacagcattttcttttatttgaagtgagtaaatgtatctttttaaattccttagtaatttttgagcactccatatgtataaagcatgtgaatatttggtagcattttacaaatgtccagagatttgtgagagttcctgagatcttcatagggggcccacaaagtttagtattacttttcacggtaatactaaagtgtattttgcctctttttactttttctcttaatagcatacagtggtaactgaaggctaatagtatgtgtgtttatgtgctttaaaaagttcgtggttttggccaggcgcagtggctc

SEQ ID NO: 9607 - DNA, 115 bp, Homo sapiens
tcagtttgtttattaaaataagatgtctaatcctctgttataatttaagctataactgttgattgttatgttattaataattggttttcaattgctaaaatataagaatatttga

SEQ ID NO: 9608 - DNA, 400 bp, Homo sapiens
caaagatctgaaccagctgattaccatcttggtcacttgagaactcaggtctgtccaataaacaccctaatccaaggtggtgttaaatacatatatatatatttttactttacgtttatttattttgaaaaatttcaaacctatagaaaaattgaggcagtaccatagtcttagtccattttccattacttagaatatccaaaagtgagtaatttataaagaaaattaatttatttcttacagctatggaggccaaggtcgaggggacatatctggtcagcgttttgccatgttggtcaggctggtctcgaactcctgacctcaaggcctgccttggcctcccaaagtgctgggattacaggcataagccaccgtgcccagccacctctgagcactttag

SEQ ID NO: 9609 - DNA, 354 bp, Homo sapiens
  misc_feature 342: n = A,T,C or G
agttaagcagtctagttcttcggcctcatactgtcactgtgggtttgtatacgtagaactttgttgtacctttttaaaataaaacctgaagccttagatatgtaaattgattcatttaaacttactttctttttttttctggagacagagtcttactttgtcacccaaggctggagtgtgcagtggtgtgatcttagctcattgtggcctcaacctcctgggctcaagtgatcctctcaactcagcctcccggttagctgggaccataggtgtatgccaccacaccccgctaattttaaaattttttgtagaggcagggttttgccatatgcccaggctggnctcaaactcctg

SEQ ID NO: 9610 - DNA, 513 bp, Homo sapiens
gtaacaggcaacttaataagcagttaatatgtattattatatttaatgtataaagctttaaatacacttatacaaatttgaagaactcagggcaccctattcctctgctcacagatatctattttaaagtcgacatgagtaagtgataaattcatcaatataaaataaatgtaaaaatatttcaaagtgattcatttgtaccagaccatttaaaaagaggggataaaatagtatcaatggggaagggcatggcgggtcaaacctgtaatcccagaactttgggagaccgaggcaggcaggtcacgaggtcaagagattgagaccatcctggccaacatggtgaagccctgtctctactaaaaatacaaatattagccaggcttggtggtgggcacctgtagtcccagctactcaggaggctgagtcaggagaattgcttgaaccagggaggcacaggttgcagtgaaccgagatcgcaccactgtactccagcctggcgacagagcgaggctc

SEQ ID NO: 9611 - DNA, 311 bp, Homo sapiens
agactggcaccgaaacagctcctcgtttctctcaaagtgaacatataattcatagagggttaacaaaataatatcgtgaagtttttcccctttaaatctctagcggtggcggggcgcggtggctcacgcctgtaatcccagcactttgggaggccgaggtgggaggatcccttgaggtcaagagtccgagaccagcctgggcaacatcgtgaaaccctgtctctacaaaaaattagctgggtgtggtggcacaggcctgtagtcccagctgctccggagggtgaagtgggaggatcgcttgagcctgggag

SEQ ID NO: 9612 - DNA, 648 bp, Homo sapiens
aacactaacccacagggaggatgagagaggaaagtgcctcctctggctgaaactgccaggatgccctctacttctaaaaacatttggtattttccatagcgcgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccaacaaagccagcaacaccccataccgccgaacagacagaaaggcgggccaggggccctccatgtcctgaaagacccagcacagcactgtccatttcacaccaggattcttccaacatgagaaagcaataacctttaatattcacgtgctcattcaacttaactgggggcgggctcagtggctcatgacagtaatctcggcattttgggaggccgatgtgggtgggtcacttgaggtcagaagttcaagaccagcctggccaacagggcgaaaccccgtctctactaaaacatacaaaaaaaaattagccaggcattggtggtgtgctcctgtagtcccagctactcgggaggctgaggcaggagaactgcttg

SEQ ID NO: 9613 - DNA, 179 bp, Homo sapiens
cttagcacaacacagaaaagctttaaacactcttacctttgactggaattacacacacacacacacacacacacatacatacacacacacacatacacacacacacactagggctttcccacatttttgtgatgcatccttaaaaataacacacatctctgaaaagtgaatgtgggggg

SEQ ID NO: 9614 - DNA, 601 bp, Homo sapiens
actgagtaatgtagtatattattttttcttcacagtgttgcattattttatatgttaacaagtagtagcttaagtaaccgtatgttttgtagctgaggaaatacctgcataatgatccagagtgttttaggagcagtatatttcaattatttttcaaatgtgatttttcaaaaaaagtctgtgtgaaataattgcaaaggatgattgtgaaacagaagaattttaaaataggaataagaataaatctgagttgagtagtttttactgtgttttgatgtatatttgtatttgtgtttctcttcttgaccatctattatttaaaatcatttctcacataaattaagaaagacgtactgagttcttaaatggttttgatagtagacatttcctttggagtacatttgtcatttcttgtactgcagtaaatgtgttttgagtcatgatgtctttaatagtaccaatttaggccgggcgcggtggctcacgcctgtaatcccagcactttgggaggccgaggcgggcggatcacgaggtcaggagatcgagaccatcctggctaacacggtgaaaccccgtctctactaaaaatacaaaaaaatta

SEQ ID NO: 9615 - DNA, 448 bp, Homo sapiens
ttaggaaaaaccaattcttcttaaatttagttcatctttctttaaaagaacattaaatgtaaccattttgtcagatccatgtattttggagcataaaatgtatgctgttgtgaccaataaatatattatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgt

SEQ ID NO: 9616 - DNA, 502 bp, Homo sapiens
ttgagcacctgtgatgtgtcaggtctgcacgaggatctaggaatacagcaggaaacaaaagagccagcccctgccctaggagtttatgagcaagggggagagacagattcaaaaaatattcccataagcatataattacaagctgtgataaaacgtagaaggaaaaagtacagggaataactagagattatataataacaaggggacccaatatcccagtgagggtggggccgtgtgtgttcaagaaggctgaggcatgtttgagcatcgatgtggaggaagagttaactaggtggctcttcttctagcagaaggcattggttgcaaatgagtccaggaaaagggacgaaggcatcttccaggaacagaagagcagctgtgaatggggcttaaaggatgggggacaagtgtgagactaaccccggaaaggtagacaggggccagatccacagggctttgaggccaaggtgtgatggcaacagggatctactgaaaatcttga

SEQ ID NO: 9617 - DNA, 618 bp, Homo sapiens
gtggtttccctccagtcttgttcattattcaagtgactctccttggtctagcaacaggctaggaggtaactatgacattttgttcaggttaagcaggaagaagaaaacaaaatctacattctcttttttatattttaaacacaagccaacaaataatttggaaagacccatgattagacagggaggattttatgctccttcaagagtaattgagattgtttaattgtatggaggaatgagcatatctcaaggggaatcgagaaggtataatatttggatgacagaatcattaagaactggctttgcaccctggctacaccgttgcacataggaaatattagggtgcaggggtgcatgcctgtaatcccagcactttaggaggttgaggcaggtggatcacctgaggtcaggagttcaagaccagcctgacaaacgtggtgaaaccccatctctactaaatacaaaaaattagctgggtgtggtggcacatgcttctaatcccagctacttgggaggctgaggcaggagaatcacttgaacttgggaggtggaggttgcagtgagctgagatagtttcattacactccagcctgggcaacaacagtgaaattctgtcac

SEQ ID NO: 9618 - DNA, 545 bp, Homo sapiens
gactgctgtagtattatggtttacagtgtttaccattttgtttaacaatattctactctagaaactgaaacattttagatgttaataaaacatctaaaatcatactatgatttacttctccaaaatacaaattacatcacaagtaagcctccatgcaatgacatttttatctttatggagtgtcatcaatatcagttaaataaatcagtgcaattgttcctaaggagaagtttagcttccacttcaccactaaaagccaagtgcctatgatgcagatgaatgcattgtacaatatatttcaatcaagtcacagactcacttccccactatccatgaaatataacaaagggctaagaaacattaaaaaatgatgtatcaaacttcccacaaaccaaaagacaggaagctattgaataatctgacacttggattacatttttattatcattaaaatgtagcaaaggggccgggtgtggtggctcatgcctgtaatcctatcactttgggaggccaagacaggcagatcacttgaggtcaggagttcg

SEQ ID NO: 9619 - DNA, 593 bp, Homo sapiens
  misc_feature 485: n = A,T,C or G
ctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtgacagtgtaagaatccaggttgtatagatgggttnttgtttgacacagatgtttctcccagtaaagagaggataaggagctggaactcgtggcacagttccctacaaaataattaattgatcatgtctactaattaaaatttc

SEQ ID NO: 9620 - DNA, 199 bp, Homo sapiens
ggaatcaagaaaatctctgaacacttatataactgctgataagactgtacattagttcagcccctgtgaaaagcagtttggaggtttctcaaagaaacaaaaatataactaatattcaacccagtaatcccattactgggtatatacccaaaagaaaataaattgttcggccgggcatggtggctcacgcctgtaatcc

SEQ ID NO: 9621 - DNA, 70 bp, Homo sapiens
gctgttgtaatcaaataggacactggttgtaaagctgctttgtaaactctaaatgtccattctcaatccc

SEQ ID NO: 9622 - DNA, 630 bp, Homo sapiens
ccatgggtcctttgtgtcttgcagaacttttttcggcaggtgttgtttacatatggttcagagcttaaagaacagctgtgttccaggccagggcagaaagcacaggcctgtctgggaggggcatcatcactcctgcctgcctgcccaaccgacctgtcggtggactgaatgggccaagtgttcagaagtccttgggaagaggatagtgtcctgaatcataatgtggtattttctggttttttgtttgtttgtttgtttttggtaaaatgttaattgcagaagtatacaggttattttatttatttatttatttttttttgaggtggagtcttgctgtgttgcccaggccggagtgcagtggcatgatctcggctcactgcaacctccacctcccaggttcaagcaattcccctgcctcagcctcttgagtagctgggagtacaggtgcatcccgccacgcctggctaatttttttttgtattttagtagagatggggtttcgccttgttgcccaggctggtcgcaaactcctgagctcaggccatctgtccacctcagcctcccaaaatgctagaattacaggcgtgagccactgcgcctggcccatacaaaaaaaaaaaaaaaaaaaaa

SEQ ID NO: 9623 - DNA, 632 bp, Homo sapiens
ggcacgagagaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaagctgaaagcaacagtacagacgatgagaccgacgatcccaggacgtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctgga

SEQ ID NO: 9624 - DNA, 637 bp, Homo sapiens
ggcacgaggaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatcccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagacgcatttgctccctggatgcatagcaggtgattctgccagcatgcaccagtgcagccttaccagttgtttacatccagcatctgttctgattgtcagcatctgtcccatgctgcttgtcacatatctggagtttcactct

SEQ ID NO: 9625 - DNA, 534 bp, Homo sapiens
ggcacgagcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccgggcataaacgggcagggctgggc

SEQ ID NO: 9626 - DNA, 312 bp, Homo sapiens
ggcacgagggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggatttggtttaataaaagttgaaataaagt

SEQ ID NO: 9627 - DNA, 504 bp, Homo sapiens
ggcacgagcctgagacttagaatcagttcagctgcagaaaacccaccttttgagttcacaccattagtgaatagcaccatgctgaaacatttcacagcttccaactctgggaaataatggagagagtttaaaaatgtaaaacttcagttagtttggggctgaacttgcttacttgaaaaatctggtgctaggcacatatatctgcctctcctttgtaaataccactccaatattattctttactattcagatccaagcttcatgttctacttgttcttcatgttctttaaatcatttgaaagttgtcaactgagagaaacatttcagaggggggaggcttttggcactggtgataaacatccctccaagagaaccgtttggggttctcttctatttgtggttggtggtttttattcttttaaaaacagctttcattgttgtttactttttgtgtaatacaaacaaaatgtaggaatcatagtttattgatttcaaatggctgac

SEQ ID NO: 9628 - DNA, 339 bp, Homo sapiens
ggcacgaggagagagagaactagtctcgagagcagttctctctctccggcacgaggagagagagagaactagtctcgagagcagtttttttttttttttttttcccccccctttgaggggttaaaattccctttttttttttcctaagtgggactaccctttttaacccccttcgggaaaccaaaaaccggaaaccctttccgggaaactttttcaaaaagccacccggggtaccaagtcactggggggaaaaccgggttcaaagtttaaaaattcattaaaaaagggtttttgggacctggcaaatttttttttgcccccgtaaacccttttttgaca

SEQ ID NO: 9629 - DNA, 59 bp, Homo sapiens
ctgacctgcctgggtccaaaggtcagtgtgtagcatcagcctgtgcatctccagcctct

SEQ ID NO: 9630 - DNA, 354 bp, Homo sapiens
ggcacgagatgactgagtgtataccctagttaaaatgatcaggggagacttaactgaaaggggtaattgagctagatttgaaggatgaggagtagcagactagtcaaagaaagggagagaagaacatacctaaacatctgatcaccagtgactgagaaagttatcaggatcaagtggaaagagaaaggactagcagagttacaggttagagaaacaggtaaaggctactatggacggcataatagttgcatcccatgttttgtctcttaagaacagttgcaaactattgaaggttttaaagctgtgtgttgggccgggtgtggtggcttgtgcctgtaatcccagcactttggg

SEQ ID NO: 9631 - DNA, 235 bp, Homo sapiens
aaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaagctgtacaagtgaagacaagggctttttatgcaagttttgaaagataggtatttattttttct

SEQ ID NO: 9632 - DNA, 358 bp, Homo sapiens
  misc_feature 17, 358: n = A,T,C or G
cgttgctgtcgattcanaattgggatgggggttggggtgaagcacacttattatcttcagttgcagtgatttcaaatttaagattttttgttgttggtttgaactgtccccttagtttcttgttatttccaatttgttctgcttagtcattacttttaattcttttcttactaaaattttatggaggttgggggaagggagttagcatcactaacctgacagttgttgccaggaatttgctctgtttactgctagtatattagaaatcctagatctcagaatcacaatagtaataaacaacaggggtcattttttcctaacttactctgtgttcaagtgtggaatttctgtctcccan

SEQ ID NO: 9633 - DNA, 460 bp, Homo sapiens
tcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatt

SEQ ID NO: 9634 - DNA, 603 bp, Homo sapiens
tatctcagagagtactgggattctgaaagtgaaaggtttatacccagtaaaagtatgggagtgctggaccaagctaacatgtacaagaagaaatatggtatatatttatggaaatagataatgaaaatgctgaattgaagagcaaagtttggacaatggagaatttttcagtttatcaatattggtgcactcttccatgaaggagtatttaactctgtgataagtaccctggaagaatgaagttatattacgactatgttggagcttgggcactagaagcatgctgaaagtgttttccactttaagtgaagtagaaatgctaagaggtggccgggcgcggtggctcacgcctgtaatctcagcactttgggaggccgaggcgggcggatcacgaggtcaggagatcgagaccatcccggctaaaacggtgaaaccccgtctctactacaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactc

SEQ ID NO: 9635 - DNA, 205 bp, Homo sapiens
accatgttaggcaggatggtctcgaactcctgaccttgtgatccacccacctcggcctcccaaatgctgggattacgggcgtgagccaccgcgcccggcccctgacttccatccttaacatgagaagctacaaacacacattgtaaaagtgcatgaatataacgataactgatgcatggtgaccatctttgccatctaccacatt

SEQ ID NO: 9636 - DNA, 393 bp, Homo sapiens
cgttgctggcggtaaaatatcattttatctcatactgttagtaggagcttcttaactactacccattcttaactttaagaagcatagaatttaaaatatagaacgaccgcttgtatggcctggatctgggcacttaaccttactaagtttatctcgtgtaaactgaccttgctaactcacgtgaggcttaaataatacaatgtggaagacttcagggcacatttttggttttttggtttttgtttgtttcttgagacggtgtctcactctgtcgcccaggctggagtccagatgcacaatctcggctcactgcagcctcctcatcctgggttcaagcagttctgccttagcctccggagcagctggaattaggtcgcccaccaccacgcccgg

SEQ ID NO: 9637 - DNA, 372 bp, Homo sapiens
aaaaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaac

SEQ ID NO: 9638 - DNA, 410 bp, Homo sapiens
  misc_feature 395: n = A,T,C or G
cgttgctgtcgaaaggacaaaaccctgactcccagtgagtctgaggccaaagctgaaaacagaacccaagaagcttaattcctgacctcagttccaatcaaacagcacgaattgtggtggacctccagctgtgctcagatggggggacacaatattggcagtaccctcttccttgccctccaggctgagtgccagtgtgggagcgtgctcatgagagccctgcacaagcgggttttgagcacatgctacgctctagccccgtggaagcctggactagttagaggcagagaacagctcaggacagacacctccctgcagagccaaacagagtgcagcgcctgcctcgctgggccatcctgagagctggggccttcccaggaaagagggagctcggngggcaccaccccatc

SEQ ID NO: 9639 - DNA, 130 bp, Homo sapiens
gaaacggtttcaccgtgttagccaggatggtcttgatctcctgacctcgtgatccgcccatctcggcctcccaaagtgctgggattacaggcatgaaccactgtgcctggcctgtttttcctctttttga

SEQ ID NO: 9640 - DNA, 518 bp, Homo sapiens
cttttgaaaaaagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagaacaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcg

SEQ ID NO: 9641 - DNA, 371 bp, Homo sapiens
cgaattccgttgctgtcggtgaatccaaattaagggatagtccacaaaataactgacaatattctttagaagtgtcaatgtcatgaaaaaacaaagactgaggattcgtcccagattgagagactaaggggccacgaggactaaacacaacatgggaccctggactaggaaagggtggtgagtgggacggtcagcaggggtgagtgggacggtcagcaggggtgagcgggacggtcagcaggggtgagtgggatggtcagcagggcgtgcatgaagggtttgctgggtgatcctgttgtatcagtggccattctctgatcattgtacaattgatcactatcctcaaagctaactttttttttttttaaaac

SEQ ID NO: 9642 - DNA, 362 bp, Homo sapiens
aatctaacgcatttattctttgacaccttttcatggccaattgagaagtggtacccagaaagacagtaatgcaacttagaaatgtatggaaaattgataatgttgagatcttaattgaggtgaaaataaccaaataacgtgtggagggacattaggaccattttgtagtattgacaaaagatacatgacacatagccttccatccaacaactctgctctaggattctagctcacagaaatacaccagggagcaaaggcataagagtaacattgtttattgaattataactgtagaatcatatgaaatgacataaaaagatatgtattgtaatgtggaaaaagtaaaatgcagaacaatatta

SEQ ID NO: 9643 - DNA, 425 bp, Homo sapiens
gttcactatgtaagtcaaaatatcgaagagggatatacaactgaaaagtaaaagttcagctttctttcctttctcctacttctataatgtgatcagactagataaaatatctctgcttttcaaaattactctctagctggctcttgaggaaaaaaaatgggggcaggaggagctggagccttcccttatttatacaagccgatgaagaggtcctagacttttggagagtcacagcaaagaaagacaaccagtcacctgatttaaacagacactattttcaggttactgaatctagatttctaggtccagtctctgaacagaaaaaaccttttagaaaaactctttgctctttacctgggcatggtggcttcatgcctgtaatctcagcactttgagaggctgaggtgggaggatcgcttgagtcc

SEQ ID NO: 9644 - DNA, 584 bp, Homo sapiens
acatattataatcaaactctacagatctaagacaaagacaggatcctaaaagcagcaagacaaaaaaagcaagtaacatatacggcagttccaatatgcctagcagcagatttctcaacagaaatcttacaggccagggaagagtggtatgatatagtcaaagtgctaaaggaaaaaaaagactgtcaatcaagaatactgtactcagcaaaactgtcattcagaaatgaacatgagataaagactttcctagtcacacaaaatctgagggagttcatcaccaccagacctgtcttacaagaaatgctaaagggtgttcttcaagctgaaaggacactaatgataaacacagaaacatctgaaagtataaaactccctggcaaaaatacgtacatagctaaatttaatttataatactctgatactgtaatggtagcatttaaatactgaatgagggtgtgtaaatcacgtatctttagtagggctaaaagataaaagtattaaaattaataactacagcaacttgttgatggatatgcaatataaaaatacttaaattgtgaaattgaaagcacaaaatattg

SEQ ID NO: 9645 - DNA, 319 bp, Homo sapiens
  misc_feature 319: n = A,T,C or G
ataaggtttcgtattaaattctctttcagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttagtaagtctttgctttttatctttttcaaaaatggagaaaacgttaagattcatagataaagaaaaaacattttctttatctgtcttttaaaacctgtatgtgattttcan

SEQ ID NO: 9646 - DNA, 140 bp, Homo sapiens
ggctgactggaattaattaaactaacctttctttgccttactacgtgcttaccacagtgaaagtaccctccctagccaggcggggtgacttatgcttataatcccatcactttgactgactgaggcaggtgaatcacctg

SEQ ID NO: 9647 - DNA, 419 bp, Homo sapiens
acaaagcctgctaaataatgggagaacaataagtagtagctattttaatattcttattgaagtattattagatagaattttattagaatgcaatggatctcaattcaatcagaaacaccatctctactaaaaacacaaaatatcattatgtttaaaactttatctctgtagttaaatgtaacattatcaccaaacagaacctgaatttgttttctggaagctatttcatcactaaacgagtaatgtaaaatgttaattgcagcctgccccatgttttctgcccctattaccaagggcaatcacctacttcacttctttgaaaagccaaaaatctcaatatagtgaagatagctgtgggtaaactgagcttaacttttaatccacacttacttcttctggtatagaaagccattaaatag

SEQ ID NO: 9648 - DNA, 514 bp, Homo sapiens
taaggtagtgttatatgcaaacgcattaagacgggaaataacacaaaagaaaaaaatgagtcattctaggtggaatgtaccttacaaagaattgggtaagatataaacacggtttatctcattggacaatgacacatcatgggcaatgttaataatctgaggctttaataaaaatagaggataattggagagttttagacagaagagtaaaataatcactatgtttttttataagtacctaattgtcatgtaaagtatattcttggccgggcgcggtggctcacgcctgtaatctcggcactttgggagaccgaggcaggcggatcacgaggtcaggagatcaagaccatcctggctaacacggtgaaaccccgtctctactaaaaatacaaaaaattgacgcctgtaatcccagcactttgggaggccgaggcggggggatcacgaggtcaagagatggagaccatcctggccaacatggtgaaacccagtctgtattaaatatacaaaaatt

SEQ ID NO: 9649 - DNA, 174 bp, Homo sapiens
gtctttggctagcatcagaaataagagactaatactcgctggaaaatacattttaaacattaataggttaatttattagcttgtaagtagtgtaaaagaaaacccctcacctgacattgtacagaactgttgaaaggctagatgcagtagcctaaataaaacacctggcactga

SEQ ID NO: 9650 - DNA, 583 bp, Homo sapiens
gcatgcccctagggaggtgggtgtgatcagttttttaacaatttttaaagcttaaggattcattaggaaatttgaggcttgttataattggacagtaacatcaaaaaatcatctacagggagtagtttttttcttttttttttctgagatgaagtctcactctgttgccaggctggagtgcagtggtgcgatctcggctcactgcaacctccgcctcccgggttcatgccattctcctgcctcagcctcctgagtaggtgggactacaggtgcctaccaccacgcccagctattttttttttgtatttttagtaaagacagggttgcaccatgctggccaggctggtctcgatctcctgaccttgtgatctgcctgcctcggcctcccaaagtgctgggattacaggcgtgagccactgcgccacgcccagggagtagttttaaagttaattttaaattgctggtaagtaagaaacgcattctactctggctgaagagcttacagcccccccacttgcaagtacccctgaccacagcacccgtgccctcggagctcccctcacccacaaactcagctcctccc

SEQ ID NO: 9651 - DNA, 552 bp, Homo sapiens
ccctccctctcccagtagattagttcatcatatgctcatttcttcaaacctaggcattgaaataaccttctgttctctctccttttaatcctttcttcctggtatccattctgcagttttcaatggcacctcaaccaccaggaatgttaagaactgatctacagtacttcccttaacacagacctaattatgtcacttcctccaaccccaaagatgtagtctaatgggggagacaggcatatagatacataaaaatgtgtgtgtacatatatgagtacatattcacatgggcacatgtaaagtattaatactaagggaggataaatcagaagccaattcattttgcctgccataagccaaagaaagtttcacatagctgatgatagctaggtgaaataatgcctagaaaacaaatttaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaa

SEQ ID NO: 9652 - DNA, 212 bp, Homo sapiens
gtttctttttcccttttttgagtttctgataaggagccaggttagctctccttacatgttggcaaagatggtccctggatgctcctatagaaagcattctataggcttagcaacattagcagcaagagagtttctgagagttcttatgcaaggaactctctgactctctgagcctggatcacatgcccacccttgagccaattactgtgccc

SEQ ID NO: 9653 - DNA, 351 bp, Homo sapiens
ggacttggatcaaactactgagcctagggaagtgaccactaccccattttaaggatcaggaaaaggaactgtatgtgggacacgatggctcatgcctgtaatctcagcactttgagaggccgaggacaggtggatcactagaggtcaggagtttgagaccagcccggccaacatggtgaaaccccgtctttactaaaaacataaaaattatctgggcatggtggtggctgcctgtaattccagctacttaggaggctgaggcatgagaaacacttgaacccagaatgtgggggttgcagtgagccgagatcgtgccactgcactccagcctgggcaacaaagagagagtct

SEQ ID NO: 9654 - DNA, 398 bp, Homo sapiens
tgcaacctccacctcctgggttcaagcaattctcttgcctcagcctccagagtagctgggattacaggcacataccaccacacctggctaatttttgtatttttagtagaggtgggctttcaccgttggccaggctggtctcaaactcctgacctcaagtgatccactggccttggcctcccaaagtgctgggattgccgacgtgagctgctgcacccagcctaacatttgagaattcttaaccagtccaattcttggggtatcttggaacttatggggaatttttacccatgatattaaagttattagaaatctgtgttcacaagtgttttttaaggtccttttcattctttcatgaatcttctaagagacaccatattctaaaattttgcatgctt

SEQ ID NO: 9655 - DNA, 590 bp, Homo sapiens
aaaccatactcctttacaaattatagaggtgctctgtgaaataggtgctactcagctttcacaatagcactgtcaccaccagctatgctaagcaccccacctttttttctttttttttctttcttttctttttttttttaagcagctgcatccttctagggatgagccgtttttgtttctaaattttctgtcctaaataataatccagtctgactggatataagaaatatggtaaataatagtacctagcatacagtaggggtcctataaatatttgttgaaagaaatttaaaaaagaatggctttcctttcttttctttttttgagacagggtctcactctgtcacccaggctcactgcagacctggggtcaagcaaccctcccacctaagtctcccaagtagctggcactacaggtgtgtgccaccatgacctggctaatttttaaaactttttgtagagatgaagtctcaccatgttgcccaggctgatcttgaactcctgggctcaagtgatcctcccacctcagcttcccaaagtgctgagattatagcatgagccactgcacccagcctgctttaactttttat

SEQ ID NO: 9656 - DNA, 415 bp, Homo sapiens
ggttacataattaaaggggagctctcatttatttatttatttatttattttaattttattttattttatttttgaaacggagtcttgctctgtcacccaggctaaagtgcagtggcgtcatcttggctcactgcaacctccccctcgcggggtcaagccattctcctgtctcagcctcccaagtagctgggactacgggtgtgcgccaccatgcctggctaatttttttggtgtttttttagtagaaacagggtttcaccatgttggccaggctggtctcgaacgcctgacctcaggtgatccgctcacctcggcctcccaaagtgctgggattacaagcgtgagctactgctcccagccctcatttattctttatgctttgttacaacttattttgaggaacatactgttggac

SEQ ID NO: 9657 - DNA, 386 bp, Homo sapiens
atgaaacagcctacaacttcagataaaatataattatcaggtagattaaaaataagcatgtttaaaatgagaagtcataaaagaagtataataataataacataacagaataagacgtcaaaaagattagactgagctacataggaaatcaaatataactcagaaatttaaaaattatcatttaaagcttactatgttaaaccaaagattatatattaccaaataaataactaatgaatggaaagaaagatctgaggaatcttcagaagcctgtgcagagagatgaagagacagaacatgcagaggaagggcttactgacaaggagtgtggactgtgaaggaccaaccatatctattagatgttcaagacatgataaatgaggact

SEQ ID NO: 9658 - DNA, 372 bp, Homo sapiens
taagctagaatttgaatgatgaatagaagctacctggttttagggaagggaaatttgtattccattataaggaattccttattcatttaccaatttatttattcatttattcatcacttttagatgtagagattcagcagtgaataaaaagacaaaaatacattcatttttggagcctactttctagctaagggaagatggacaattaagatagcaatgtactatgtgtactatattttaaaaaacaaggcaaagaatgttggagaattaaaattttaaacaatatgtgcaaaaatcttgagtttgaagtactaggggttgagaaaaggtcactgtcgctggcgcttggagacagaagaggagagtaggaga

SEQ ID NO: 9659 - DNA, 631 bp, Homo sapiens
tgtagattaacctgaaatctcagcattttgaaacttcaatgcctaataagattcaataatttcttcaggtggaataaactagttcccagagataaaactaacctattttgtattgttttcagaatacagtactactggccgggtgtgggggctcacacctgtaatcccagcgctttgggaggccaaggtgggtggatcacttgaggccaggagttccagaccagcctggccaacgtggtaaaaccccatctctactaaaaacacaaaaacaattagccaggtgtgatggtgcgcacctgtaatctcagttacttgggaggctgaggcaggagaatcacttgaacctgggaggcagaggttgcagtgagccgagatggcgccgctgcactccagcctggtccacagagcatgactgtcccaagaaaaaatacacacacacacacacacacacacacacacacacacacacacacatagtactattacaagactatttcatacttgatatgtgtttcatattaagcacattgggagggtagaacagatcactgtatacttttcccttctaaaaaacacacactgagatgagtcaggcataatgactcatgcctgtaagccctgtactttggca

SEQ ID NO: 9660 - DNA, 432 bp, Homo sapiens
attgcaagttcatcaaggtctgttcagttggttgcagcatgctcctaacaaaacttaagtcatagatttcattctatggggcaatcttatctgcaatacacaggataggcaaagacatactgcatttctaactccaatcaattaaacctaagtactggattcagtgtatcactgttgctacaaaattactcaagctctatgttctaacaataagatcagaggtatcataaggtatcacagtttctagagactctgagtttagaagaagaaacctactgaaggaggatttatcaatgaaatcatcttggataaaggcctaatgggatcaagaaaaaattgttaagtgaataaaaaattacagtagccacatgcattgaaaaagacaatgaataggttgggcacggtggctcatgcctataatcctagcatttt

SEQ ID NO: 9661 - DNA, 235 bp, Homo sapiens
aagtggagagggcagccctcagtagacactgaacctgctgtcaccttgatcttggactccctagcctccttaactatgagaaagaattctgttatttataaattacccagtcttgggtattttgttatagcagcacaaatgaactaagacagccctagctacaaatcacactatttgcataggctatatggtgtgacccaagaccccatcatagatcacactgttagcataaact

SEQ ID NO: 9662 - DNA, 545 bp, Homo sapiens
tcctgcctcagcctcccgagtagctgaggtgcccgccaccacacctggctaatttttgtatttttagtagagacgaggtctcaccatgttagccagggtagtctcaaacttctgacttcaaatgctctgcccgcctcagcctcccaaagtgctgggattacaggtgtgagccaccatgctccgcctgccctgttgtttatttacaaccgctgcctgttttctccagaactctagcccccaccccatttgctataagactctgggagagagaggaaggggaacagaccagagggcaagaagccctctgtggttgggggtggagacaggggcactggatacaggttcagacaggtggtcacttgaaaccagtcattcacggtcaccaaattgtcacagacgtcaaacgcatgtggccactcagtatgtgtgacccagccttggccccagagtctggacatgtcagccaaattcagtgtgcagtatgagtcccagatgtggctatacaaggtcatggacatgcatacatgcacatccagcttccacac

SEQ ID NO: 9663 - DNA, 97 bp, Homo sapiens
gctggagttgtcctgatggccagtagaggtggctgttgatagaattgaaagcttagggccaggcatggtggctcacacctgcagtcccagcaccttg

SEQ ID NO: 9664 - DNA, 214 bp, Homo sapiens
gaacatcacttggctgcagtgagctatgattgtgccatgcactccagcctgggtgacagagcaagaccctgtctctaataagaaagaacaaagaatttcataagtaatacttattcattcactattattaaattctagcattttcttctatctgcttcagaatttcgtttattaaaaaataaaatataggctggtctcggtggctcatcccaac

SEQ ID NO: 9665 - DNA, 440 bp, Homo sapiens
agaagtgtaactgacagataaagtgctttaggtatgaatagacagggagaagccagatggaaaagcagagttataaatacatatgaaacttacaactccacaagataaacatattctttcttaacatctaaggatattttcaaaatatataatcattggtcaggcacggtggctcatgcctataatcctagcactttgggaggctgaggtgggcagatcacttgaggtcaggagttcaagaccagcctggccaaaatggtgaaagcccatctctactaaaaataaaaaaattagctgagcttaatggcgtgtgtctgtaatcccagctactcaggaggctgaggcaggagaattgcttgaacctgggaggcggaggttgcagtgagctgagatcccgccattgcactccagcctgggggacaagagcgaaactccgtctc

SEQ ID NO: 9666 - DNA, 313 bp, Homo sapiens
ttttattctgttctgttgtaattatttgtttctctggacctaagtgaatctcttgaagaaggtatatcactgactagaagctaatatgaaagggaaaattagaaaattcaaaaacatgaggatattaaataacatattcctggaagactgatgggtcaaagaaaaaaaatcaaaaaattggccggacacagtggctcacgcctgtaatcccagcactttgggaggccgaggcgggcggatcttgaggtcaggagattgagaccatactggctaacatggtgaaaccccgtcactactaaaaatataaaaaatt

SEQ ID NO: 9667 - DNA, 470 bp, Homo sapiens
  misc_feature 254: n = A,T,C or G
cctgaatgcatttctactacctgttgactaacaagtccttaaccagcaaaagaatcttattcactgtgtatctccctattctgagctacaattctaaaactgtcccgaatagatgtctttattttcctctggtcaatttcatatttgaacttaaggctaaatgtctatacgtgtgtgagtgtgtgtctgttggtatgcaacaatgaaatgtgtatgactatttaccaatatcgaggtcctattccaggtatcanggatgatcagactttactctttaagttagctttcgctgcaagacttgctctggccaataaaactgagcaaaaatgatgtgtgtctcatttttgctatagtgttgaagaatccatgtgtgggcctccatggttttccccactgttactgaattctatgacattctaaatggaagaggcttcatcagcttgggtctcagagtagaaatgacatgaatc

SEQ ID NO: 9668 - DNA, 446 bp, Homo sapiens
agttagcaaataatggggagaaattatgaatatatagtagacacaaaaatattgataatatacagcacacattttttataaaattaccaagatacaattggactaaatgaatttctgaatattatgaaacataattatctaagatcaatatcaaacatcatattgcttctcgagtataaagacatttttaataaggccagaacaagacagtggtatctgttccaacattattaaatattctacctagtgtagagaaataaatataagcagaaccatacatgtatgatcatttaatatatgataatggtggctcaaccaacttgggaaatacgagtttttcaataaaggaatttatacaattgtttatttgtaaatatatgtcaatgtgtgttttgtgtgtgtatatagttaaacctcttcctaatttcaaacatgaatatgaattc

SEQ ID NO: 9669 - DNA, 510 bp, Homo sapiens
agatcacttgaggtcaggagtcacagaccagcctggccaacatggcaaaaccctgtctctactaaaaatacaaaaattagctgggcgtgatggtgggcgcctgtaatcccagctacttgggaggctgaggcaggagaatcgcttgaaccaggaggcggaggtttcagtgagccaagattgtgccactgcactccagccttggtgacaagagtgagactctgtctcaaaaacaaaaacaaaaaaacgctgaagagcatcaagagcgagggaagagcctgacctgggggctgagtagcaccaagtcaacgctgttggccgacagcccttgccccgctagcaggtttggcctcaagcttcccagcctacccagagtgaggaatccaggagacccccacagggccacatcttagaagtcagggccagaagcaagcctgtcccaaccaacttgccccgaagactgcaggggaaatggctgaacagaatgagaaaaaagcagaatggagcccgacg

SEQ ID NO: 9670 - DNA, 137 bp, Homo sapiens
atggcacatgcagcgcaagtaggtctacaagacgctacttcccctatcatagaagagcttatcacctttcatgatcacgccctcataatcattgtccttatctgcttcctagtcctgtatgcccttttcctaacact

SEQ ID NO: 9671 - DNA, 482 bp, Homo sapiens
cccaaagtgctgggattacaggcgtgagccactgcgcccgaccggttcacattattaaaataaacttaaatgttatatagatgttattaatgaaagcccaatttaaaataagaagcatgagccaggcagagtagcttacacctgtaatcccagctacttgggaggctgagatgggaggaatgtttgatgccagaaatttgagatcagcttgggcaacatggtgagatcctgtctctcaaaaaatgatataaaataagaagtatgagttgaatatataccattagtatgggaatgctaagggaaggttctgactacttactacactatagcgtaaactattacagtcagactaacaggagcaggaattctgactagttttggttagttgatttttaaaaatttatttatagcaaagaatgaaaaatttatttagatactataaacacttactttttaaaaaaatatataaataggcattaatt

SEQ ID NO: 9672 - DNA, 70 bp, Homo sapiens
gctctctaaataacaaagcccacttaattctagtatttggcctccacagccttatatggagatatgaaag

SEQ ID NO: 9673 - DNA, 318 bp, Homo sapiens
tctcctgcctcagcctaccgagtagctgggactacaggcacccaccaccctgcccagctaatttttgtatttttagtagagacaggatttcaccatgttggccaggctggtctcgagctcctgacctcaagtgatccgcctgccttggcctcccagagttctgggattacaggcatgagccatcacacccggcctgggactcttcttgcagtgagccagggccatgggacccttcaaaagttgctccaccctaatccccaaaatatctttttctcccgcctgtcccaagtacctggcatcatactatatgggtcaact

SEQ ID NO: 9674 - DNA, 80 bp, Homo sapiens
gtgtgtgtgtgtgtgtgtgattgaaagtaaagtaaaacctgacactctggccaggcgcagtggctcacacctgtaatccc

SEQ ID NO: 9675 - DNA, 494 bp, Homo sapiens
atagaaattacagactacactagagatatttcataccttcaggttatttgtaaagaaatggcaaatattacctttatcatttttgacatttatgttaaatgagataataatcactgctatttgaaacctgtcatataggatttgagtctgtctgctggtcaggaatatttgcctcaccccaggatttaaagtacttctagaaagaagccaaaggccgggcgtggtggcttactccttgtaatcccagcactttgggaggccgaggtgggtgaatcacctgaggtcaggagttcgagaccaatctgatcaacatggagaaaccccatctctactaaaaatacaaaattaaccgggtgtggtggcgcatgcctgtaatcccagctacttaggaggctgaggcaggagaaccacttgaacccgggaggcgtaggttatgatgagctgagatcgcgccattgcactccagcctgggcaacaagagtaaaactccgtct

SEQ ID NO: 9676 - DNA, 386 bp, Homo sapiens
tgcagggtctggtagcccacatcaagcaattttatcctaaaatgcatggggaaatattaaagggttttaagcaggagaagagcatggtcatatgctgaaaagatttttgtatcagaatagaggagttgtcagctgtcagtgtgtcagggcggaaaatagtaataagttggtgcgaaagtgattgccgtttttgccatacatactattaatggcaaaaactgcagttacttttactcactatattactttgactagggtgatggcattggaaatggagagagataaatggatttggaatacgtttaggaggtatagttaatagagttagggaaaggattgggtacgacagctgaaagaaagtacaaggggtgggtgaaaagtgactc

SEQ ID NO: 9677 - DNA, 500 bp, Homo sapiens
caaatacattacatgaaagaggtggggctatgaaaaattatctattattagctagacgtgaatttgtttctaaaatgagacccatggactctggagctgggagaaagaaccagacaactggtaagcatgggtcctgccaggtggggcagacttgtggaagtccctgttcattgggaggaagcattaggagagctctgagagatgaagagggagtgacaaaaggaaggagagcaaaaaaagagaggcagaagaaacaccaaaaccaaatgtttcctctttaaaaatgtttgcttcggtcaggcactgtgacttatgcctgtaatccccgcactttggaaggctgaggagagaggatcacttgaggccaggagtttgagaccagcccgggcaacatagcgagacccctgtctataaaaaaacttagaaaaattatccaggccgggtgcggtggctcacacctgtaatcccagcactttgggaggccgagactggcagatcac

SEQ ID NO: 9678 - DNA, 72 bp, Homo sapiens
gcattgttcctcctgggtgtaagggttaagtcagccctgcttgaaagaaatacatcaaaatgtgtattcttt

SEQ ID NO: 9679 - DNA, 635 bp, Homo sapiens
accactgatccaagcaactggttctcccttctccactgggctacagctctgagcttctgcacaaagagtggagtctccatctttaaatattctgcttatttttcaatttgtcattatactaagaggtcatgtgtgtggattacttactttgtgctgggcagtatgctaaattctttatacatggtaactctttatgcttgtaacttcgtgaggtatcacagtcctcatttttacagatgaaacttcagcccagaaaggtaatttgcccgaacagcaaattctgaaactggaattggtggctctggtgcccaagcttgcatatttagaccaggcatcagtaatagcctcagttttgtttattgctttgttaagccttagttttgaagcacttgttaagtgcgaggctccatgtagagtgtataaacactcaatctctgtgtgacgacagctccaaggagcagtccagcaagttctgtctggccaaatctagacctggttttgattaactttgttcatgatctctagatcactctgctctatgcttgaacctgtatgcttgagtcaagcttacctctctgatgggtgaagaaaatgatatttcactgttatattaattttatttttcttaccacaaa

SEQ ID NO: 9680 - DNA, 400 bp, Homo sapiens
attgcaaactgatcctatctaatatagaacctttgattcaccatccgtgtcccagaaataaatctatttctcctacagtcttccatatctcagtaaatggcaccaacatccaaccagttgttagaataaaatctagatgtcacccttatttcctctcttagcctcattcttcatcgaatccgtcatcaactcctatcaattatacctctaaaatatatctcatgtttttctcttcatcgctattgctaccaccctatccaagtcactattatctctcaacagtactacttcaacatctatctaattccctatttccaagccactcctccccaccccaatagtcagagtgatcttttaagaatattatcggccgggcatggtggctcacacctttaatccc

SEQ ID NO: 9681 - DNA, 401 bp, Homo sapiens
tagcagtgaaatttattatcatttgtattaagaagagatgactattagatgccatgccataaccaactcttctccattagattaggaggaccaggcctgatactgaatattggaactgttggcaagaaaatgaaagttcgtgactgcttgagttatttttaaaactctagttgcatggctgttatgtctcaaatactatataattatccctagttactggtatctttagcatatttgaaaccatccatatgtgacctaaagccacacagctatattaagacatttttgaacaatcaaagcaaatgacactttaaattaaaacaaaactaatatgaagcaactactttaaaaaaaaaaattgggaccaggcacggtggctcatgcctggggggccgaggcag

SEQ ID NO: 9682 - DNA, 578 bp, Homo sapiens
tatcagtgacctaacaataactctataataatagcttacagtctacaaaacatacacacacaagaagtagtgcaacacagagggtaagagtggagctttgaggtcagctgggttggctgcggactgtggccccaccactgtctagttgtttggctttgggcaagctagctaacttctctccacattagtttctatccagccttataaggttgttatgaatattaagtgagatgatataaacaaagagctcagcacagtgcctgggatatagtagatgtgcaacaaatgtcagctattggtatttttgaaatcatctactcatagcaatctagtatctagctgcaagactgtgcagacactgcacagggacagagtagcagcagacaattgaaagttgactgtgaggccgggcacagtggctcaagccggtaatcccagcactttgggagcctgaggctgacggatcacctgaggtcgggagtttgatactagcctgaccaacatggagaaaccccatctctactaaaaatacacaattagccaggcatggtggtgcatgcctgtaatcccagctactc

SEQ ID NO: 9683 - DNA, 538 bp, Homo sapiens
  misc_feature 333, 367: n = A,T,C or G
taatcagcagataaaagctcagatggtcagaaacatatagaactataatgccatctccaaagtattgcatgcatacaaatgacgttcaatccgttgaatataatggagacacactatttcaaaaattaagttcttctttcttgagctttaaaagtatacacatttacccaaatgaattaaaaacatgcacacaaatatttatatcaaaagtgtacatgatttccaaaacttggaagtaaccaagatttacttccatgggttagtgcataaattaactgtgatacatatatactatggaatattattcagcaacagaaataaatgagctatcanaccacagaaagacatggaggaaacttaaatccangtggctaagtgaaagaagccaatatgaaaaggctacattctatatgatttcaaatatatgacattcaggaaaaggcaaggctgcagagacagtaaaaagatcagctaggtgcagtggctcacgccactttgggaggctgaggcaggtggattatctgaggtcaggagttca

SEQ ID NO: 9684 - DNA, 575 bp, Homo sapiens
gcggtggctcacacctgtaatcccagcactttgggaggccagagcaggcagatcagtaggtcaggagtttgagaccagcctgaccaacatggtccaactccatctctactaaaaatacaaaaattagctgggtgtggtagcacacacctgtagtcccagctactcaggaggctgaggcaggagaatagcttgaacttgggaggcagaggtcgcagtgagccgagatggggccaccgcactccagcctgggcgacagagtgagactccatctcaaagaaaaaaaacaaaacttatgttttgaaagtcatgatataactaagtgagaaaggatgggatactaaactacacaaaattataacttagtaaataaaacaaaatcaaaataaaaatgaaaatacgcatcttaaatatattactattacaaacaaaaaaggtttaaacatattgactttattaaaaacagagtttttactatacttctagaatacaacttatgaaaataatgaaaggtattacaatgtttaaagatacaagttttaggccaggcgccatgccccacacctataatccctgca

SEQ ID NO: 9685 - DNA, 347 bp, Homo sapiens
aggtatagaaaatgaacaaagtatatccctgatttttgcttacatcttttctgagtaagacattttgtgcttacatactatggattagttaatcattggtcagttaaatacaaaacatcatttcgatctggtagcttagcaacacttaaaaaaaaatcagctaatgcttagcaaaggtttccactcaagatattagattatgaaaaacttcctgcttaacaatagtaattccttgcagagtttatttgacttcattcaaaaccattcaccaatactagagttaggtgccggggtttcatatttccttttagcacttttagtgtttggttttatcagaatcccaaatc

SEQ ID NO: 9686 - DNA, 538 bp, Homo sapiens
  misc_feature 234: n = A,T,C or G
gcctcccgagtagctgggattacaggtacctgccaccacactcggttaattttttgtatttttagtagagatggggtttcatacattggccaggcttggtcttgaactcctgacctcatgtgatctgcctgtctcagcctcccaaagtgctgggattacaggcgtgagccactgcgcctggcccaattcataacatttaggtatgggatggagtgtgatatgggtgtaatgtangcatgggggatggggagggaatgagaataacattaagagttttccatatttataacagatcctaaaaattaaaatgcaaagcaatttagaatacattgataagtaaaaagaagaaaataaaattacctaataatgactgagaacaattttatgtctaaccaaatattttttatttgtatttatacttattattttcaaactgaattaaaaatctcatcaatgtacgacaaattcatttccacacacatatatatacatttagattattttatacacacacacacacgcacacacacaaaaaata

SEQ ID NO: 9687 - DNA, 61 bp, Homo sapiens
aaactgagttctagccgggcgcagtggctcacgcctgtattcccagcactttgggaggccg

SEQ ID NO: 9688 - DNA, 534 bp, Homo sapiens
tgagccactgcgcccagctgactctctgtctcttaatattcgtttattccattttccaaattaataggaattggcctgcacgtatgactgcctaggataaaaaatacacttccagccgagcatggcggctcacacctgtaatcccagcacttggagaggccgaggcaggcagatcacgaggtcaggaatttgaggccagcctggcaaacatggtgaaaccccatctctgctaaagatacaaaaaattagccaggcgtggtggcgcgcacctgtaatcccaggttcttgggaggctgagccaggagaatcgcttgaacccgggaggcagaggttgccgtgagccaagagcgtgccattgcactccagcctgggcaacagggcaagactttgtctcaaaaaaataaataaaagactgggcgcggtggcacacgcctgtaatcccagcactttgggaggccaaggtgggtggatcacgaggtcaggagatcgagaccatcctggccaatatggtgaaactctgtctactaaaaatac

SEQ ID NO: 9689 - DNA, 594 bp, Homo sapiens
cgccttgtataccattagaggtttttaaacagaggagtaacaagataggacctgcattttagaaaggcaattccccaaaactaggactgtgtggacaacaggcccactggatcttcccatctcaaagtgaagctgagggttcagcttctaaaatagccagctcttagtcatcgcattcagctccacagttgatccagccaactgagctgcagagctgctctagctggctgcctatgagaagtggaaggaaagagaattggagcaactatcaggttaataaactctgtggagagagccaaaccaaatttccaaggccccacgattagtttgtctaaatgaagcacaacaacataatgctgataggcctgacttcctttagtgttaatggaccttacagatcttctctaacttctgggctgtggccttgtctgtcttgtttaccacaatatctctagtaccagcagagggcctgccaatggtacatgttgataaatctatgatatgaatgactagtcacttgttctggagctctgggtaccccaagcttggctgaatgctcccacaattgagtctttcattattaattaaagaagt

SEQ ID NO: 9690 - DNA, 483 bp, Homo sapiens
cttcagcagatctctggagctgtatgtgcagctctgttatctggcattctgtctcacaaattctagtttccctgcgcccaccaaagaggcagtcatgttgtttacctcatttgtttttcctctctcagggtcacggttctgcaccaagtgttgtccaatacctgagaagttttccccctcatgtgttttgtccagttttcttattgtttatgattggaggacatttctcatgcagttacttttttatgaatgaaagcagaggtcaggtggcacaattgaacactgcacagaaagaagagaagagggaggctggagaaaaacattctatgaagtttaaaacatgattaccggccaggtgtggtggcttatgcctgtaatctcagcactttgggagggtgaggtgggcagatcacctgaggtcaggaattcgagaccagccttgccaacatggcgaaaccccgtctctactgaaaatacaaaaat

SEQ ID NO: 9691 - DNA, 64 bp, Homo sapiens
gggctctgcccaaagatgcccacagacttaagacccctgggctttaaaaattcatgtgaattgg

SEQ ID NO: 9692 - DNA, 400 bp, Homo sapiens
tcgaattcggcacgaggctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccagggcttccgggtagtcctggctgaagactgctggatgaagtcgctggttcctctgatgggggaagtcaggcagcagatgggagcaaacccatttatatcagctttgatattgacgctctggatccctgctatgcgccagggacagggacaccctgaaattgctgtctcacttctaggcaggctctggagatcatcaagggcttgcaa

SEQ ID NO: 9693 - DNA, 432 bp, Homo sapiens
gtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccagtgacaatacttgtatggagtttattttgcacatttgcaagtatatgagtgtaatcttgggactggaactgcaaaggcttcagaggatttgtacacacagatatgacgaaagacttgaaag

SEQ ID NO: 9694 - DNA, 391 bp, Homo sapiens
ggcacgagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttaaacatggggtctcactgctgttgccgaggctgaagtgcagtggcacaatcacaactcaccaca

SEQ ID NO: 9695 - DNA, 585 bp, Homo sapiens
ggcacgagcagacgggcatttgtaccagggtctcacaccatgtgcatgtctagtgaaaaagtcatgaaacgattctcttttaaaaagagggagcccacggcacggacgcttcctccgtctctgaccccatgagccgacctctgactgagggaggccactggcacccagcgggcctgcgtctccttcgcgagctgaattcactcgtctcttagatgttttttctggtgcttcagttcacactaacgttttagaaacactatttgaaaaagccctttgtgcagtcagaagggtgtgtacgcagccccgtgaaagccctggagcactgggaccttttccttgtgctccggagctgttggcagaggtgagtggggcgggcagctgcccggggcacagtccgctcttgtcttctttccttagcgcttgcttcaggaatgggttaaggcctcctttcctcactgctggtagagctcagctgatgagtgcctgctgttccccaggtccccgtgggcacgctggtgaaggagggaggcagagttgtggccgacctgtcttgcgtgggagatgagtacattgccgcgctgggcg

SEQ ID NO: 9696 - DNA, 579 bp, Homo sapiens
ggcacgagagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaac

SEQ ID NO: 9697 - DNA, 671 bp, Homo sapiens
ggcacgagggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactaca

SEQ ID NO: 9698 - DNA, 331 bp, Homo sapiens
ggcacgaggagagagagagaactagtctcgagagcagttttttttttttttttttccgggagggaaaaaaaacttttttggaaccaaaaccaacccttttttttaagttcccccaccccaccccaaacctctttttttccaaaaaggaccccagggcccaaaaaaggtggccttattttaaaaaaaaaggccatttttttcttgggggggctaaccaaaagccttttaaaccaaaaccagggcaacctggtcctttaaaaggagccggctatatttaaccaccaaggggaagcctagggccctcccaaagttttttaaaggccccccggaa

SEQ ID NO: 9699 - DNA, 268 bp, Homo sapiens
ggcacgaggaagagaactagtctcgagagcagttttttttttttgtgactttggcatctgaatattggggcttcttgttaaaccggtaaagtttaaaaacctaaggagtatgcattgcactttagggctaacttttttcttcattaactttatgggtaaataggcaccatattttttttgaaaaacattaacccaaattgctaatagctccatgttacggcttttttccacacgttccaaattgatttagggaaaagcaaaaatggaa

SEQ ID NO: 9700 - DNA, 616 bp, Homo sapiens
gtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagccca

SEQ ID NO: 9701 - DNA, 394 bp, Homo sapiens
ggcacgaggtctgggctaattagtccatttgggcttaggaaaacagtggcacctatttctgagatggtcttttactaacactgtgcattgcctgcatcttcctgtgcatggctttgtttgctcctatctgcaggttggtgagccccacagggcaggctgtactatgcactgtcatagcccaggaaagccactttcagaccaggtggcttgctccagaacccaaggctagtaaggggcaaagctgggtctagaacttcaactttctctttttctactccacgatatgactgacatttaggtttgcacacagcagcgttacatctatgggttctaatttaataatgataaataatttttttttctttttttttgagatggagtctcgctctgtcgc

SEQ ID NO: 9702 - DNA, 602 bp, Homo sapiens
ggcacgaggttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagcttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcagctatgctgggactcatgtatgtctactggactcagctcaacatgttccagaccttgaagtacctggccatctt

SEQ ID NO: 9703 - DNA, 679 bp, Homo sapiens
  misc_feature 531: n = A,T,C or G
gcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctggtttttaaatgatcatgaaaccaaaaagagactgatcattcaggcctcagcctcatcctccccaggacccctgtccaggattgagggtccaattctaagacacgccttgntcttcacaaccctaacttgacctgggggatgggggggttgctttcctgcattgatgacaaaggcctggcgcggcaaaagggtggtccagggccggggtactccggggccggcggatctttgaacgtacctatgtagaccttctgtgcg

SEQ ID NO: 9704 - DNA, 540 bp, Homo sapiens
ggcacgaggccgcttgtgctgcagccatggtaaggctggaatccgtgccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctcta

SEQ ID NO: 9705 - DNA, 611 bp, Homo sapiens
ggcacgagtaatgacccaattacaagttctaaatgcctgtaagattggaggttattggaggattcttgaatttgattatgagatgaaacttctgaatcatgtaactcagcttgtggattctgaatcatggtcttttggtaaagttcctttgaacacatgccttcaggaactcggaccattggagccagaggaaatgatagaacactgtcttaaatgttatgggaagaaatatgtagatgaaggcgaagtttattttgagttggatgctgataaaatatgtagagcagcagcacgaatgctacttcagaatgcggtgaaattcaatctcgctgagtttcaagaagtgtggcagcagagtgttcctgaaggaatggtaactagtcttgatcagcttaagggtttagcgctggtggatagacactcgagaccagaaatcatatttttgctgaaagtagatgatttacctgaggataatcaggaacgttttaatagccttttctctctaagggagaagtggacagaagaagatattgctccatatattcaagatttgtgtggagagaagcaaaccataggtgcattactcactaaatattctcgttcttcgatgc

SEQ ID NO: 9706 - DNA, 610 bp, Homo sapiens
ggcacgagatgacttgccctttgttcctagctctgtgcctggcctcagaggagagccttggtgcacgtttgactttttaatctttatttgaacctgttacacaccgtcacccccactgctctgcttgccacagacatggaaggttcactaaggccttaaggcactcatgcaagctcacaagagaaagaaatctgtaaggcatgtagaatttggactcaatcatgttggtctttaatgtgcctagagcaatggaatgggcactttgggggcggtggaattcaagacgctctggctgaagattcagaagtatctggtaactctcttttccttctgggcatcctctcctctgttctaatcctcccttacactcattcctggtccattgtattctgaccacatccttaatcatggtcaaaactattgagtcctgggcacattggtcatgaaggaacaagaaggcaatgagagactctcatgccaaccactgccctgaaagccctgctgttcagacagcaaaggggccagcactggccaagctcttatgcttgctctgaaaccttcttgggaggagtcaatagggtctccttttgaaagtgtccctggccttttg

SEQ ID NO: 9707 - DNA, 519 bp, Homo sapiens
ggcacgagcggtcgcggagctgcggccagctttgggagggccggccccgggatgctacacacaacccagctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctgttgttccggatggtccgtggccgcccggtgcccatccttatggtgacctcagg

SEQ ID NO: 9708 - DNA, 372 bp, Homo sapiens
cccacgcgtccgaaaatcttaaaatatatgaattccatgagataagagatgaagtatgaggtaagaatactatgtctaagctgaaaaggtacctcattaagatatagacagaaataaaataggagggagatgaaacatatgaagtatattgtgaaatttaataatgcattggaggcagtaaagaacagagtcattgcttcctcaaagaataggtaaaatgaagaacaaactgatggagacctatccaaacacagaggataagactaggaaataaaaataacaaaagataaagtactagaaatagagatcagaaaattaaaagctatctatgggtcatatgtctttttagtaagaactcagaataactacaac

SEQ ID NO: 9709 - DNA, 313 bp, Homo sapiens
ctgcttgagcccggaaggcagaggttgcagtgagccgaaatcacgccattacactccagcctgggtgacgagcgaaactccgtctccaaaaaccaaaaagaagaaaagaaaaaatttgagggatcccttgtcctggaagtggctgaacttgggggtggtacaggggagacaactgatgggcctagcggggtccgtgcacaggggccggtgtcactgtgctgggctgttggaaatcccctgactgctcgctggccaaggtctgtgaatgggaaacagactgtgtctgggagtgtgggggctatgcattctccct

SEQ ID NO: 9710 - DNA, 383 bp, Homo sapiens
cgttgctgtcggaatggcatatatctaatggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgctattgggctatatgaagaggccagtaaaaaatggggcacaccaatacaagagttgcggaat

SEQ ID NO: 9711 - DNA, 527 bp, Homo sapiens
tctacgggaaaataagtaaaacctgcccacatgcttgtgatggtattggaatatttcagtcctttgagaagaacacttcactttgaaccttacgggctattttccagactgtccaaatatgatttgtttcctctcaccatcatttccagtaccctgtcccaagtgtttgaatatagacattgatatgccctgatttttgctctacttcagaaaggatcggggatgtagtttagccctctaggagcttggaactaatttgtttgtctatttcttgtttgcttccaagttgcttattatgtgttacaggtagcagctacagctgaaggccatggtgaattgctggtgatgtaaatactcccagccctgactgatcggccttgtttaaattttaaggattagtaaacaggttgctgctggagctacttctgcttaggctattaggagaataaatgttgaaggaaatggagtccaattcggggcttactggctttgacagtacgaggaagcttttcagtgccacacgtgtc

SEQ ID NO: 9712 - DNA, 514 bp, Homo sapiens
ggcacgagcagctactcgggaggctgagacaagagaatcacttgaacccagaaggcagagattgcagtgagctgagatcatgccactgcactccagcctgggtgacagagtgagactccatctcaaaaaaataaaatattgtggtattggcacaggagtggacaactaggtcaatctaggaacagaccttttggaacttgatatacatgaaatgactcaaccaatcagtgaagacagggtggatgttcactgaatattggagaaaactgaactcccccatacaaaagaaaacagatttccactttacacacactcaaaattaaatttcagattaaatactaggatatttttaatgatttattaaatttttttttggtagagacagggtctcaatatgttgctcagcctagtgtcaaactcctagcctcaagcaatcctcccttctctacttctcaaattgctgggattacaggctgagccaccacacccagcctgatatttatttttaaatatc

SEQ ID NO: 9713 - DNA, 566 bp, Homo sapiens
tcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaccttgggaagtgccaact

SEQ ID NO: 9714 - DNA, 78 bp, Homo sapiens
gagagagagcttaagtgaaggcagtttttatggcgttttgtagtaaattctgtaaaatactttggtttaatttgtgac

SEQ ID NO: 9715 - DNA, 60 bp, Homo sapiens
atctgtcaatgaacatgaactgagttcttcaactacaggttgaaggataattaaactttt

SEQ ID NO: 9716 - DNA, 431 bp, Homo sapiens
gatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagt

SEQ ID NO: 9717 - DNA, 422 bp, Homo sapiens
ggcacgaggaaaaactcaaaagcttgtcactgcagcttcagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaacgcaaatgaagggaaaaaagaaacatgggatacagcagaagaagactctggaacg

SEQ ID NO: 9718 - DNA, 427 bp, Homo sapiens
tcaccctgcatcaaaacacatggagcagactgctgagccagctcaggggaagcggagagaccccaggagtgacggtgagaatgcaactcacttgtcattacacaggatatggcagatcggatttgaccaacaaaatggggaggaactgatccagatgtggaatgtgacagagaatcccttcccactgccatggaacatttataaaaataatcatacgttaatcaatgaagaaagggagccacacatttaaaaaagcagaaatcgtacaggccacttcctcagataaccattctaactagggtcaaattatacatcaggactgaaaccacaaacatataggaaataagataaagtcttttggtttttttgagacggagtctcactctgtcacccaggctggagtgtagtggcgcgatcttggctcact

SEQ ID NO: 9719 - DNA, 573 bp, Homo sapiens
ggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcctgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataat

SEQ ID NO: 9720 - DNA, 399 bp, Homo sapiens
cggggaggctgaggcagaagaattgcttgaacccgggaggcggaggttgcagtgagccgagactgcaccactgcacttcagcctgagtgacagagtgagactccatctcttaaaaaaaaaaaagtttattctttcctgtagggtaaccaaacctgaagttttaaaaaaacagggggggatcttctttagggaactgggcaattggcttctcatgttaacaatgttgacaacaacagccaaaaggaaaaatgtaaaacccaaaaaaaaagctggcccaggggctcacccctgtagtctggcactttgaatggctgaggcggggattgcttgaggccaaaagttccaaaccagcccagccaacatggcaaaaacctcgtctttagtaaaattacaaaaatt

SEQ ID NO: 9721 - DNA, 70 bp, Homo sapiens
agcaagcagcaaaccagctacaagtggaccttctagtgcagttgttcctaatacctcatctcggaaaaag

SEQ ID NO: 9722 - DNA, 514 bp, Homo sapiens
gatacaactaaagaaagagatacacaatgacctagatatatgagtgaagaaattatccagaatgtatcacagagaaggaaatgggcaaaaagaaagagggtaagatatatatttataaacacacacatacacatattacataaaatgagaaagtgacatgtctttcattagttttccaagagcagaagggaaaaataatgggaaaggaatagacaatatttgatgagataatagttgagaatgtttcagagctgataaaaagcaccatgacaaatttgagaagctgagagaactgcaagcagaataacgtaaagaaaatatgcttctagagacatcatagtaaaatgaagaacatcaacaacaaagaaaatctcttaaaagttgccagagaataaaagattaccttcaaaggagctgaggcagttacaatgatagctgactatacaggggcaaaaatggaagccaggaaacactggagtgatatctcaatgtgctggaaaaaatttgccaatct

SEQ ID NO: 9723 - DNA, 585 bp, Homo sapiens
aaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctc

SEQ ID NO: 9724 - DNA, 510 bp, Homo sapiens
catatggtttcaagttttgatgcaaatctgaaggtgaggcattcaatttgaataaaagaagaacaaagtttgtttaaattaggccaattcaaacttgttctgtgaaatgaatgtactgtctttattgtttcttttcctttatgttgtccatagctttttgcatattctcttagaatcacagaactttgaacttgagaggatctatacaaattatgcatttgactcttctcacacagggggcttcttaaaactatagacttctgaacctcttttgcaaaaattataattcagctcatgaggaatggtcccaataatctgaattttaaaaaatgactcagggctgggtgcagtggctcatgactgtaaacccagcactttgagagcccgaggcaggtgaatcacgaggtcaggagttcgagaccagcctgaccaacatggtgaaaccccatctctactaaaagtacaaaaattagctgggcgaggtgtcacacctgtaatcccagctactca

SEQ ID NO: 9725 - DNA, 579 bp, Homo sapiens
cagcctcctgagtagctaggattacaggcacgcaccaccatacccagctaatcgtttgtatttttagtagagacggagtttcaccatgttggccaggctggtctcaaactcctgacctcaggtgatccacccgcctcggcctcccaaagtgctgggattacaggcgtgagccactgcacccagccaatagatgatgaggattctataaatgagtattcatgtaaaatgcctagaataatcttgaacacggtgaagtcattccaaggtgggcggctcggcacgagaatgatgaaagggccgtctgctgggaaagcagggactgttgaatatcagagtgagtttggctggctgagcaggtgcatccttcctggccctggctctaggagctctgccttcccaggtagtacagggttctctagttaggtggtttttgagaagctgcaattctcagctggacaccgtgggcttagagtaggaggtgtaaaaagttaatgcaagctctaggatgtcaagcattgggtgggttgcaggaataatgtgagaggaagctaaaaaaaggtatgtttggggccgggtgtg

SEQ ID NO: 9726 - DNA, 610 bp, Homo sapiens
  misc_feature 491: n = A,T,C or G
atgcctcattataagttaaaagagtgctgtagcatccctgtacaatttgggcaagtgtttctctgcctgtggatgtgtatttttaatagcaaccagtgcagtctacttgtctattctgaaagttcattaccattcttttaccttccctgtttagagtatcgtatttcctgtacttttaattttggtatttcttagctcctataaagggtagcaggtggcctcttttggagcctgaattctattcatgtgcaagtaaattcagagagctatcttgtctcttctgtagcccctttctagagggagctgatttcagtggtgggagattatttgatgtctcttcttgtttggtctctagtgattccattgaacctgcatctgagactgtgggtcttgaaataaaaatcctgtttatggagaaatgttcaagatggttatttcatcacctataaactattaggagtttatgagaacctacatttagcacaacctanaactgaagttatctctttaagttctcacgttattttgtatattaagattcaaaaccaaaatatcattggtctaaacattgttagaatagaaccagactatgccaatatcactaatatag

SEQ ID NO: 9727 - DNA, 579 bp, Homo sapiens
ttttacgaatttcatctagagtgtgtctggtatatctatgcatatgattcattttccatgttacaatgcaagctgactcttattgaaatagacggctgggaggcagcatgatggagtgaaaatagcatgcacgttcaaatctgaaagatatgggttcaaattcttactcttctctgttatttggagaaagtcatccacctcctgtatagtacttttcttggctttaaaatgaatagatgtcttgaggatattactgttctcaattaaatcaaaatttttgcaaaaaggtctgacactggccgggcgcggtggctcacgcctgtaatcccagcactttgggaggccgaggcgggtggatcatgaggtcaggagatcgagaccatcctggctaacagggtgaaaccccgtctctactaaaaatccagaaaaattagccaggcgtggtggcagatgcctgtagtcccagctactcgggaggctgaggcaggagaattgattgaacctgggaggcggagcttgcagtgagcagagatcgcgccactgcactccagcctgggcgacagagagagactccgtctc

SEQ ID NO: 9728 - DNA, 508 bp, Homo sapiens
taatgccctcattttatgttgtgaattttagaaagaaataacaattaagcatcagtcaattaccttcacttaggagaggagaaagaaagcatagccctcagacagactggggaggcaggagagaattatgcaaaacaggaggtttactaaggtcctatagatacatgcctgggttcttccaaaaataccttcacccaccctcagatattgggcttaggattctaaagtattgagctcagttcttgtggcaacaggacgtaagattctaaacagtcttggtttgaaatggaataagattatgtggaattgctttaacaaggcatgtgaacaagttgttcttcactggcaaccctttccctccacttttgcttcctaagatgtaaagccgtggttggctgaaatgattttttgcataggtgtgcctaaatattgtggaacacaacagcatttgctcgttattaaatgtgtcagattcactatcttctactgtttattttcaatgctacat

SEQ ID NO: 9729 - DNA, 419 bp, Homo sapiens
atttgtgagtttttcattgtgctttaagaaattctcatagtggaattaggaggactttggtttatccacaaatgctcaataacttctaggtactacttatccttccctttcgtaatccccctttaaagaatacacatgtgcacaggctgagtgtaaatgtgctttcccaagacagatgccataagtggcacgtgggaaaactgaaatccttttgtttttcaagggacagggtgtgaaatattagttctttttctcttttatcagaagctagttttgagttgaaagtggcataagccggacgtggtggctcatgcctataatccaagcactttgggaggctgaggtgggtggatcacctgatgtcaggagttagagaccagcctggccaacgtgatgaaaccccatctctactaaaaata

SEQ ID NO: 9730 - DNA, 461 bp, Homo sapiens
tacggctgcgagaagacgacagaagggtttcactaccaaaatatatgaaagaactctaattaatcggctttaagaaaaagtgcttgaatcaagtattttatcagaaaaataggaactgattcaaatgtcttttagttcacatgactggtaagtatttggtaaataaaactagtttgttggtttaaggaaagcagccatctcttctaccagcaaaaatacccatgtattttaacttgagggttttacaggctgtagaaacgatgaacaaataaataacttgagttgatagctagctttttaaaataagctactcaagcataattattaagaatgaataaattggctaggcatggtagctcatgcctgtaatcccagcactttgggaggctgaggtgggcagatcacctgaggtcaggagttcgagaccagcctggccaacatggcaaaaccccgtctctact

SEQ ID NO: 9731 - DNA, 443 bp, Homo sapiens
gaatcaacaaagagtggtttaaggccattactgagaggcacagagctaccactaatgaaggtggtgcgatggcatagagaagccttctgaacaactcagctttcaacatgtgcaagaattactttgacaaaaaaattacaattttctaatttaaaaaaaaattactaagttattgggcttatctaggctctagattgggggatatgaaaatcatttcaagtaattatctcatagtatttcatcccactgactacaaggctacaagagaaacctcccttgggagaaaatgaagaaaaatatttaatagggaaacagactaatacagagagactgccagaagagtggtctcattcaggtatatgatcagaaattttaattcctaaaaggcatcttcatgaagagaatacgtgtatagacatttttaaaaataatataaaagctgg

SEQ ID NO: 9732 - DNA, 488 bp, Homo sapiens
gttcacgccattctcctgcctcagccggagtagctgggactacaggcgcctgccaccacacctggctaatttctttttctatttttagtagagacggggtttcaccgtgttagccacgatggtctcgatctcctgacctcgtgatctgcccgcctcggcctcccaaagtgcagggattacaggcgtgagccactgcaaccaaccagaacagttcatcttaattaggcttttgtatttcaaactctagtagtattcttgtagtgaatttctacaagattgttccaacacaaacctaacattaatcaaattttgattgtccctttgtagcattaagattagatatttaatagcagaagctagtgaagccattagaaggataaaaggtatccttagatttgcacagctggcataaaagacagaaataatacatcagtttcttgccgtcaggttagtacacttcctagtatttcacatttgacactatattc

SEQ ID NO: 9733 - DNA, 543 bp, Homo sapiens
tcagcatcatcctgataccaaaggctggcagagacacaataaaaaaaaaagagaattttagaccaatatccctgatgaacattgatgcaaaaaccctcaataaaatactggcaaacagaatccagcagcacatcaaaaagcttatccaccacgatcgatttggcttcatccctgggatgcaaggctggttcaacatactcaaatcaataaatgtaatccatcatataaacggaaccaaagacaaaaaccttgatttttaaaatgtggatctatttgactttttatttcatgtaagaatcactgttaggaatatgaaagtatatttcagcttaaatatagtgacattctgctaccctatatttaaattgaacctaaattaaacttgtattaatcagtatctgtcacatgaactctaccagctccctttcacctaaacaaacagtcacacacaacgaaatagaaatcttttctcagccaggcgcggtggctcatgcctgtaatcccagcactttgggaggccgaggtgggcggatcacaaggcca

SEQ ID NO: 9734 - DNA, 162 bp, Homo sapiens
  misc_feature 94: n = A,T,C or G
ctgggactgacagcctgcagggtttccttgggcgcggccccaaaattgccttcaaaacaaacccgggacggttgaaagccttcgaaccgtgcangggatgcctcgggccctggcccttcgcttcctctcttgtgttatggaaataaaaacaaataaaactac

SEQ ID NO: 9735 - DNA, 571 bp, Homo sapiens
ggcacgagattgaattttctgataattgaagcttattaattgtctaaaattatcttaagatattttctgatgtacatcattttaaaatgagttgcacacatttctattctgtttcaacatattcaatataattttcgctcttgttcatctgttggtattcattatataattcagacgtggtctcaggtctggagacatgtgaagttattgctcctacactgagtgtttccatgtcattatgccttaatccttatttagacacagctatgataccctctttacaacataaaggataagcaaaaggatgtataaatgtatcctgggctggaaagtggcattattgactggccattggccatcagcaaaggggcctgagtggaaggatatgaaaggatgggtgtaatgtagatgacgggttgatgggtgcagcaaaccaccatggcaggtgtatacctatctaacaaacctgcaggttctacacatgtgtcccagaacttaaagtatagttaaaaaaaaaaaggatgagtggtgagcacagctgacacaccccacgaatatctggggggctttg

SEQ ID NO: 9736 - DNA, 564 bp, Homo sapiens
ggcacgaggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatg

SEQ ID NO: 9737 - DNA, 564 bp, Homo sapiens
aagttacacttaaacagtgatacatagattgccagataatctttggaagggctttgattaattaggcttcagggaaattgtgaataaaaacataaatcttgcaatagggtaggggaaagaaaataatcccactcctgaagtgatgaaatgaagagtggctagagaggagaaaagaaccaggacaggtgatatattagcaactgtcagtgtgaataatccagggtatgacatttctaatttagcctcacatttaaggtcatttctgattcaacctcaaatgatccttctagcctactgctcccctaaatattaatatattctttgtgccagtcacagtgtattaacatttccctgaaaacatcttaagcattttttttaacctatgtgacttttgccttcttccatctcaaccttttaaaatcttacctacctgtcccttacttcatcaaatgtttctaattatttagaaacaacttctaaatttcctaatatatatgtatatctgagttgagtatgtatgtgtcataactaaattagagctaaaatattcttttattagtatga

SEQ ID NO: 9738 - DNA, 476 bp, Homo sapiens
tagaactcctgtagatgtgtagaagagtgatgggaaagagaaaggactgatgtccttcttttcattgaaaaagatattgtttaggtcctacaatggcttaggtatggtttgagactctggggttacaaagcaaagaaaacctggcctctgccctgctcagagaacagcagggatacagcatgttagcaaataagtatatagtgtggaaaggtctgtagtcaatagcagtcattttgacaataggaaaaggaatgtgtgaaacttctgggtctgtgtgtgtgttggggttggtgggtcaagggaggggatccaaagatggtttcactaagaagggaaaaacaccggacctgagacttgaatgcaagtagaattttgccaggcagatgatctgttcttccaggtagataatccatcctgggcagacaaaaccaggctgtagaaggaacaccatgtgtggagcaatagaaatatctcat

SEQ ID NO: 9739 - DNA, 300 bp, Homo sapiens
ctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctgga

SEQ ID NO: 9740 - DNA, 576 bp, Homo sapiens
gggcacgaggctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttaaaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttt

SEQ ID NO: 9741 - DNA, 461 bp, Homo sapiens
ggcacgagctgggcttggcaacgagggactcggcctcggaggcgacccaaaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaaaaaagtttctggaagaaagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttg

SEQ ID NO: 9742 - DNA, 475 bp, Homo sapiens
gtgttgcccaagctggagtgcaatggcgtgatctcggcttactgcaacctctttctcccgggttcaagcaattctcctgcctcagcttcccaagtagctgggattacaggtgcatgctaccacgcccggctatttttttgtatctttagtagaaactaggtttcaccatgttagacaggctggtcttaaactcctgacctcagatgatccacccaccttggcctcccaaagtgctgggattacaggcatgagccactgcgcccggccaggaatttattttaaggacataatttaataggttcaaaaatctcatattcatgaaaactttttgaaacctataatagcaaaaactaaaaatgaggttaaatgtttactaatagaggaaggcttagtaaatcatagtaagtaaaaatgatgaaatatgtagccattaaaaataatactttacaggccacgcctataatcccagcactct

SEQ ID NO: 9743 - DNA, 351 bp, Homo sapiens
ttttagttataagccacccaatttatgtgttttgttataagatcccccaatggactcagacaatttggctggccagttctggctctgggtctcccatgaggctgccatcgtacatcagccagggctgcagtcatctcaaggcctgactgggggcatcttggaggctggataccacaagtacctaccatgagccaggtggtgtacaagtaatatatagcaacaacaatcataatgtacaattggaagttatttcatgtttactatgtgtccaaatgttaagtactttccctgagttacctcctttatcttcataaaaaccctacaaatttggtctggttatcatctcattga

SEQ ID NO: 9744 - DNA, 89 bp, Homo sapiens
cgcaacttctgcctcccgggttcaaatggcacttcacttgttaatgtcacaaagtgccaccgggtgcagtgcctcatgcctgtaatcct

SEQ ID NO: 9745 - DNA, 350 bp, Homo sapiens
tcgggagcagaagaaggaggaggagatgaataggtgaaggagaggaggaggaaaggagaagagaaggaggaggagaaaagaaaggagtggagaaagaggagaggaggagaaaaaataggaaacgaagaggagaagaataggaggaggaaagggatgggagaaaagaaaaaggaaaagtaggaggagtagaaaaagaggagaaggaggaagaagaaagagaaggaggagacgaaaagaatgagaaaaagaggagaggagaatgaggagaaggcgtagaagaaaagaaggaggagaggataaagaaggagaagtagaggaggaggagagaagaggaaaggaggaggagagga

SEQ ID NO: 9746 - DNA, 427 bp, Homo sapiens
ttgcccaggctggtctcaaactcctgggctcaaactatcttcctgcctcagcctccaaaaatgctaggattacaggcatgagccaccacacctagcctcaaatagttgtcttaacaaataaatggttgaaacctgatatacgggaattagggactctgttttgtgaactgttcatttctggagtcaaaatggctttgatggtgaatttggttatctaacaattgtttccagaagttaggggttaagcagagtgcaccacccacaggccaccttacctgtcctgccttggcgttctcacagacaaaagcttcatagaatctggggaactctggagcattgtcattcacatctaagactttgattgtgacaggaacacttccaacctgggagggattgtctaaagggaacacaaggaaaaccaaatctg

SEQ ID NO: 9747 - DNA, 275 bp, Homo sapiens
atatctcatatactccataaatatatatacatactctatccacaaaaattaaaaataaaaaaatagtaacaaagtttttctaaatttaatagtgttttagaaattaaaagagacccaagaataaaaggaaaggtgaactaagagagatatagggtaaaaagaaatataagagaaataagctatgtaagagatacaggccgggcgcggtggctcatacctgtaatccaacactttgggaggctgaagtgggtggatcacctgaggtcaggagttcg

SEQ ID NO: 9748 - DNA, 247 bp, Homo sapiens
agacagtgttccaccatgttggccaggctggtctggaactcctgacctcaagtgatctgcccacctcagcctcccaaagtgctgggattacaggcatgagctgtgacacccatcgtgtctaatttttgacagataaaatgatttcatgatccaacatttccttaccagtgagggatacaataaaataccaattctcactgggcctttacacttctttttttttttttttaaaaaaattttttttttc

SEQ ID NO: 9749 - DNA, 250 bp, Homo sapiens
ctaccattttaaattaatttagcattggtctgttacaaagtgcatataatttagattcagaagaattgggcttcagttatacttttgtcactttctcaatatgtaacctaggataaatcgctccctctttttcaaatttgatgtgtacaaatgtaatatgaagtacttggcaacgtcaggaacatttgataaggcaaggtatataaagatatgtgtgtagccaggcacggtggctcatgtctgcaatccc

SEQ ID NO: 9750 - DNA, 331 bp, Homo sapiens
catttacatatacttgaaaatcattgctattaatttctaatttattttctctttttgtcagataatacacttcgtaggatttgaaaccttttccgtttgttgagacttgttctatagcacaaaatatagtctaatttggaaaatgttctgtgtgcatttgaaaaggatacacatttgaaaaagacatgctattgttgaatagagtgtcctatcattatctgttaggttaaagcgctgacaatgttatttcagggttctttgtagattagcttatttctctttctagctccatttgcttttgcctaacatatgtaaaattctgatattagag

SEQ ID NO: 9751 - DNA, 430 bp, Homo sapiens
ataagcaaaaggcccagtccctgtcctcaggagctcatggtccaagtcaaaatcacataaaaacatttgagtcccctttgaaatgagtattgttttcttgaacaaattttcaacttgctgtagtttttttcctgatcactttcatcctgtctttccaagatgggatatgtttatttagaaattacttcacctgggacagctgcttctctcttttgctcaggcccgtagcactgcaggatgggcaagtgtcgtggacctcatactgctaggagtctctgtagtcaccaacaagatcagaagtggcatgataaacagtacaagaaagcccatttgggcacagccctgaaggccaacccttttggaggtgcttctcatgcaaaaggaattgtgctgggaaaagtaggagttgaagccaaaaagccaaattctg

SEQ ID NO: 9752 - DNA, 323 bp, Homo sapiens
gctcataaaactgctgataggaaagagttataggtctcactgttcaagaggcttgggttttaaagtcatattagcctcaagagataaggtcttggggtccttaagagtccagtggttagaaatgagatgtctgcagttagacctcttaacatcatcacggatatatttgtgtttaatcccagcactttgggaggccgaggcgggtggatcacctgaggtcaggagttcaagaccagcctggccaacgtggtgaaaccccatctctactaaaaatacaaaattagctgtttgtggtggcgtgcacctgtaatcccagcaacttg

SEQ ID NO: 9753 - DNA, 404 bp, Homo sapiens
cgttgctgtcgggagacttgaggagttgctgaggtgccacgtgtacctgggcacgaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaaacttggacgtgattggactcccagg

SEQ ID NO: 9754 - DNA, 514 bp, Homo sapiens
  misc_feature 473: n = A,T,C or G
tgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcanaacacaaggaagcactaataatttctaatacaaaaagtctg

SEQ ID NO: 9755 - DNA, 413 bp, Homo sapiens
aaggacccgtcctgggaaagaacgtcataaaatacgaaaaatgtgttagaacactttattttcccagccgctttcaaatatatttttatcagtggttcattgttaaagaaggtgtctatactttaaattttcagttttttgcagggaatcatggagctgagaatttcacagatactttataagccatagtacatgagcttaataggctgtgttttgtttctcatcagttaacataatttttgtctattcatttaaaaatttgttggatccctagactaagttgaaatgtatttctaatagtaggcaattttaattttcatgtagttgtttaattgttctctaattaatggaccaatgaaaaatgagttcatgtgtgtgtgtgtgtgtgtgtgtgtgtgtgtgtgtattctacc

SEQ ID NO: 9756 - DNA, 371 bp, Homo sapiens
  misc_feature (1)...(371): n = A,T,C or G
ggcacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctttctttctccctccccccccgggcgcgctcatttatctcgtctcttatgtctctctctctgtgtctgtgacagacacactctttttcatatagcgcgctcccttttctttgctctcggggggggtctctctgtacgcgtgtgttctctctccagtgagtgtgcacgcctaggtgagagagagtnnnnnnnnnnnnnnnntgtgtgtgaattttatatatttctatatctctcactctctgggtgtcacactctccgtgtgtggg

SEQ ID NO: 9757 - DNA, 331 bp, Homo sapiens
gaattaattattccaatcagaaatggaggccttacctcatttgggcaaagattagtgctagttattgaagatttactaataaatgatctgttaaggaatttagttttttttggatatgttgttttggttgttgaaaactaaggtataattataatagttattttttgaagatatgtttggctagccatcaattagaagttagagagtttgtcctaacagataagctataaccctcacattttaaaacatgcatagtgaacaatgaacaaaaacaaattcaaaattttactaatgtaaagctgtatattgtgattgttaaaacacttttttt

SEQ ID NO: 9758 - DNA, 440 bp, Homo sapiens
ggcacgaggctgagagtgcttgatacacccttgaatcccctcttatatgatgccccagcccaggagagataaaagcatcagcaccatgagattcacctgcctctggtcgttagggaacaatggaggcctgcgatttggagttaaactctcagtgatctctgtgttgacaacaccaaagctagaggaatccattaggatgtgggcatggttttcccggaaggctgactgatcagttctgcaaatgtttgcaagtacagggcagaatttcatccagcctcagaaccttgagccaagactcagcatcagcaaagccaaaagtttcatttctttgactgtgggagtgctagtcccaacctttagatggccattcagttttaagttcaataagcattttgattgagaaatactttgctgaggagtgaaaagtccttggctttgaa

SEQ ID NO: 9759 - DNA, 154 bp, Homo sapiens
ggcacgaggagagagagagagagagagagagagagagagagagagagagagagagagagagagagagagagagagagagagagagagagagagagagagagagaggggggggggggggcctctctctctctctggggggcgcgccccccccccc

SEQ ID NO: 9760 - DNA, 324 bp, Homo sapiens
tcctccccgctcatgtgccacacctgccatattgaaccgtctctgcactaatcttctccacgggcacggagtggagggaacgtcttgggaaaggggagagcttgacctccatctaggattcttttatctggagaaaaagaacactcttgaactatgcaatgctccgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagc

SEQ ID NO: 9761 - DNA, 257 bp, Homo sapiens
tggagggaaattcagatcatctaaacccttcagcccttcactggacagaagaggaaactgaggctccatctgcatgacgttcccagagtcacggcacaaattcatggaagaagcagcaggaaactcagttctccagtctgggtccaatgtgtgttttagaaatatctccacagggttaatgactcaatttttcatgcatgattgctagtaatgacaatcatgttatgtttgtttctgtagctttggaaatcactcct

SEQ ID NO: 9762 - DNA, 379 bp, Homo sapiens
gtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaa

SEQ ID NO: 9763 - DNA, 445 bp, Homo sapiens
ggcacgagcccaccaagagctgcatagagcacgtttagctagagtaggagtttgcagtgctcatatgggaaatgctgctgctatacttttaggaatttctgagtgcaatttagaaacatctagcacacttgaaacactgcgtatcattttcctcactcatgaatatagtcatcagaattcataaatagtttacctgagccctttaacaacctcaaataggccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccatacattcttaccaggcactgagagtcatggggagtttaagactccatcccacatactccttttgaaactg

SEQ ID NO: 9764 - DNA, 215 bp, Homo sapiens
gtttctccatgttggccaagctggtcttgaactcctgacctcaagtgacccacctgcctcagcctcccaaaatgctgggcttacaggtgtgagctactgcgccaggcctaatatctttttttttttttaaaacaaatttttgttttgggcccaggttgaatggcaggggggaaatttgggttaattgaaccctccgcctccaaggttaaaaaaat

SEQ ID NO: 9765 - DNA, 523 bp, Homo sapiens
ggcacgaggtgatccgcctgcctcagcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaattta

SEQ ID NO: 9766 - DNA, 453 bp, Homo sapiens
accattctgtttttcactttcagtttagtattcaataaactacataagatattgaaaactttgttataaaataggctttgtgttaacataggctttacccatctgtatgttagtgtaagtgttctgagcatgtataagttaggctaagctaagctatgatgttcaattcattaggtatattttatacatttcaacttacaatattttcagccagcaacatgtttattggaacatagccccattgtaaattaagaagtatctgtataggtacataaagtgaattcagaaatcatgggaatgttagttttgtatgtgtgttagtgtgtgcatgcacaatgcatgtgtgggtttaaaagaaaattgagggttctaagataaatataacaaggatttataagacttaacagtgagaaaaaataattacaaaatttccaattttaaaaaaattgggct

SEQ ID NO: 9767 - DNA, 444 bp, Homo sapiens
gtgcactccagcctgaaccagtactttatgtgaaggggagaacaccctgaattgggtcagcttctccaggtatacaaaggatttcttgaagtaatacaagatgattgaatattatactgatggacaatctcaaagtataaatttaccaccactgcaagtgaaaatccctatgagatttttcgggagtgaaaggtaggtgagatcaataaaattattttttaaataacacaaagtaagtgctagctgctcaatagcattttggggttaagcacgtaacatgcattaccttatttaatccttaaaaaattttaagttcaaatttaggcttagaaagtttaaataatttttcaagggtcacatggctgtgaggaattggaactccaacatagatctgaaggccttgttccaaaacctgagatttttaaaaaccgtgctgtatattgc

SEQ ID NO: 9768 - DNA, 290 bp, Homo sapiens
gtttctccaagtctccaggttcatgatgcatatcatcatcatttccaaatctcagagtttcctcaagagagggcaaccacatttgtaactgtcttctttctgtcaattaagtgtgtgtattaattactagggctaggtcttttcattcctttgcacgttttaagcaggaatgagatgaggcaaagcccatttgtaggttattttttagtttaactatgttaaattaaactatgttggtcaggctggtctcaaattcccgacctcgtgatccacccaccttggtcaaccaa

SEQ ID NO: 9769 - DNA, 556 bp, Homo sapiens
tggtgtgttatgtaatatttgcaagttccaacttgggaagttgaactttactgaactttaaaatgtagcaactacgtatggctgtattttaaagctatagtaacaactgagcatgttttcttgtgttttgtttttcaaaatgtattctgtgggataaagttgccactgagattttcaggtctctacaatgattaatttgaaaattttacatatggattttaaccattttttaaactgtaattagaatccactgtcaaatgtgttacagaaagtttagcccgttgagagatccccttcatactaacttgcaggttcactcagtttgggggcatgctttggggaacaaccttcttctgccatttacctttaatttaaaattgtgggccaggcacagtggcttacccctgtaatgccagcactttgggaggacgaggcaggtggatcacttgaggtcaggagttcgagaccagcctggccaacatggtgaaacccagtctctactaaaaatacaaaaaatagccaggcattggtggcgcacacctgtaatcccagctac

SEQ ID NO: 9770 - DNA, 426 bp, Homo sapiens
gcttggtaaccccttctgcatgtcttagattcacaggtagaacataccctccaattttttggacatctgtttctcatttctgctgaataatatgacattctgatggagaaaaagacaaaggaggcattttttccctattgcttcctttttacttaatttaaattatattagttaaagcagtctctgtgtgtgtgtgtgtgtatgtgattcaaacttttaaatcatagataaaatggcaaaatataaagaccaagtttttctcaataaaatgttattgcaacaggttttaaaaacacacaaatttctggctggggcacagtggctcacacctgtaatcccagcactttgggaggctgaggtgggtggatcacctgaggtcaggagttcgagaccagcctggccaacatggtgaaaccttgtctctac

SEQ ID NO: 9771 - DNA, 648 bp, Homo sapiens
gctggagtgcagtgacgcgatctcggctcactgcaacctctgcctcctggattcaagcgattatcttacctcagccttctaagtagctgggattacaggcgtgcgccaccacacctggctaatttttgtactttagtagatacggggtttcaccatgttggtcaggctggtcttgaactcctgacctcatgatccgcccacctcggcctcctaaaatgctgggattacaggcgtgatcccacaattaccgtgcctggccacagtttttatattatcttgatttagggcatctatataaaacaaataattaaataaaatcagtattttaaggtaagaaccttacattttgtagtctcaactgactcatatatcctgttttcgtagtccctctttttatgattaatgttatcttttcattattttatagttttaagcctatcttgtctaacatttctttttcagatggccaagtgtgatggttgtaaacgacagggtaaactaagcgagtccattaagtggcgaggcaacattaaacatttctgtaacctattttgtgtcttggagttttgtcatcagcaaattatgaatgactgtcttccacaaaataaaggtaaaattaaacttagctaatgggatttttatgtcagt

SEQ ID NO: 9772 - DNA, 605 bp, Homo sapiens
caaagacagtgattacattgacataacaaatgtccattggggcaggcaaatttctactgagtctaaaaagcattccaaattctaggagcaaaagttctgattttccttaaaatctttgcaaataaacagcaaagggtattctggatgtcttgtcaatgcaaattaggtttgatttagagaagttttaaatttaatcgcaatgaaaagattagttaatacatgaatctttttatgagaaaaaaatcattattctggataaagtcataattgtttgtttacaatattaagagcagacacctaaacatacaataataccaaagtattgagaaaattaccactggaacaccatctcaagttatcacaccatttacctctttagagccagttttgtataagtagttagaagtggttttggtttttttgctaaaattttactttgttttagtaatatctagggaatacttttaattccattaaaataccttcatagaaagtgttaatgtgtctaccatgccatatgtttatttttactttccccaagttaggtagatagagcaagtcctgctaccataagtttaaaattattaagacaacgggctttttta

SEQ ID NO: 9773 - DNA, 82 bp, Homo sapiens
ctgttgtcatggcggaggtggacggcacctgctactgagccgcccgcctgtccccacccctgaataaactccatgctccccc

SEQ ID NO: 9774 - DNA, 99 bp, Homo sapiens
gcaggataaagcatataacagcctctctatgcacactactatcctcaaggatatatctggaaggatacaagattattattcctctctcattctactggt

SEQ ID NO: 9775 - DNA, 516 bp, Homo sapiens
tacaacctctgtctcctgacttcaagcgattctcctgcctcagcctcctgagtagctgggattataggtgcgtaccaccactcctggctaattgttgtatttttagtggagacagggtttcaccatgttggtcaggctggtctcgaactcctgacctcatgatccacccgcctcggcctcccaaagtgttgggattataggcgtgagccaccacgcctggcctagttttgtttattaactgctaggtatgtgagactgttatatttttcaatatgctggttgcaatctaccgaattgattttatggccctctaattggtcgcatcctacaatttaaaaactactaccctaaagaaattccagcacatggctacagggcattcttcagagtagcaaaaatctgaaaacaacccatctatccatcaatagatcgaataagcaaattatactatgttcataaaatggaatatgatattgtagtgaaaataaatgaactactaatatctgcattaatatg

SEQ ID NO: 9776 - DNA, 387 bp, Homo sapiens
ttcccggtgttttttgagtgttactcttcaaaatggttacaaaactgcaaatattatggtagaaatcacatttgtcctttttaaaaaaaataaatgtttttggcaacaaatcgacattttacattattcccatataagatgaaatttctaagccagaatttaccatgagaaaaaccttaaagaaatgggccgggcatgatggcttatgcctgcaatcccagcactttgggaggccgaggtgggtggatcacttgagttcaggagttcgagaccagcctggccagcatggggaatccccgtctctactaaaaatacaaaataaccaggcatggtagtgcatgcctgtaatctcagctactctggaggctctggagcgagagtctcttg

SEQ ID NO: 9777 - DNA, 584 bp, Homo sapiens
agagtttcacactttaagggcactgaagatatagaatccaaaacaaaggcgggaagatgaaatgtgcagggtgtgtgctcagtgtacatttcacagccctgaaacttctcaattaaacaacttcagtttcgggccgggagccgtggctcacacctgtattcccagcactttgggaggctgaggcgggcggatcacgaggtcaagaaaccaagaccttcctggccaacatggtgaaaccccatctctaccaaaaatacaaaaaattagccgggcgtggtggcacccgcctgaagtcccagctactctggaggctgaggcaggagaattgcttgaacccagaagtcagaggttgcagtgagccaagatcgcgtcgctacactccagcctggcgacagagcaagactccatctcaaacaaacaaacaaacaaacaaaaaaccaacttcagttccaccactctaaacatagcaaggggaaacttcagttccaccactctaaacatagcaaggggaaacagtaatgcctataaaactttgcttaaaggccaggcacagtggcttatgcctgtaatcccagcactttggg

SEQ ID NO: 9778 - DNA, 577 bp, Homo sapiens
actccacattgacctcaatcactcttacccttcacattgtgtttgctctttttgcctcccacgctttagtcacttctttctcactttcatttcttctttctagtcttcctttatccactcctaacactaatctcgtagctgtagacttatctttttcattgtcctcattttttaagcataggtgaaataccggaattgatatagatttaatttaattttatctcctatgttatgcattattgagaccagaaagtagataaatcaaattggtcatacccaatcctttcctacaagatagtaaatgttttgaagtcacagactattgccatctggaatagtccttctttgtaacccagtataatctccacaaaaatgttatttttaaaaaatccctccactctttaacattctgatgacctgtaagctttcaagaagtcttcagtgaaaacctgtctctactaaaaatacaaaaaattagccgggtgccgggtgtcgggcgcctgtaatcccagctactcaggaggctgaggcgggagaatggcgtgaacccgggaggcggagcttgcagtgagccgag

SEQ ID NO: 9779 - DNA, 627 bp, Homo sapiens
  misc_feature 487: n = A,T,C or G
tttgcacgtctgtatctctttctagacggtgaggctctccgggccaaggaaagtaattcatccatcctggcattgccagcatctaggaacctggaacagtgaaggaacacagcaaagtttgctaaagaaactaatgaggctcctaatgagactaagaatgaattaatgcctcgttttcaaaccatctgtgagctgggtcactatgaaggtggatgatcccatcagttccatgtttatgtttatcttgttctcaaactcggtttcctgttccccacccctcactgcatgctgtctctctcacatacacacacacacacacacacacacaattacacactcacacagacccactttcactcacactcacacacactctcacactcacacacacatacgctctctcacatacaacctcacacacacacacatacgctctcacacaatctcacacttacacacacatatgctccctcacacacacactctnatacacacacacagacccactttcacttacactcacacacactgtcatacacacacatatgcactcacacacacccactcatgctcacatacacacacacactctcacactcatactcacacacacatacacactatagt

SEQ ID NO: 9780 - DNA, 568 bp, Homo sapiens
agacgacagaagggtacggctgcgagaagacgacagaagggacaagggtccagaaatagtacttactggaattcttcatgataaatgtggtacgccaaatgcaggaggtaattcaaaaatgttctcaaaagtattgttgtaaatggagaatggatttcttcaactggtatgtcattattggctaaaataagaaaattggagaggatgcctgacatttgctagaaccttccattttatttgcgcctggtatacaattcgaagaactgaatatatgcgcttatttcaaaatgctctgaacgtgtgtataagcgtccaaccaaaaatttaaaactccgtgaaagccaggcacggtggctcacgcctgtaatcccacactttgggaggctgcagcagcaaattgcctgaggtcaggagtttgagaccagcctgggaaacatggcgaaaccctgtctctaccaaaaatacaaaaaattagcccaggtgtggtggcgggcacctgtaatctcagctgcttgggagactgaggcaggagaatcgctggaacccgtgaggtggtggctgcagtgag

SEQ ID NO: 9781 - DNA, 621 bp, Homo sapiens
ccaagtgggagcttcaagttagtcctgcctcatatctgccatttttcctaaatggcaatacttttatactaaatatataagcatatgaatccactacaatactgactgcatagtgaatttatatcttcttctcaatatttgtcatcaattagtgtagacagctagtgggcctgaaagtaccgagctaagcttttcttagtttgaatggcccttaccaatgagtttaactacatccagtttttgttattatgtaatgttacattgaaccattttaggttataatgatgaataaagatatgcaaatgatgatgttgaaagtgccacaaaagtacaccaaggaggccaggtgcagtggctcatgactataatcccagcactttgggaggctgaggcaggtgggtcacctgaggtcaggagtttgagatcagccgggccaacatggtgaaaccctgtctctattaaaaatacaaaaattagctgggcatggtggcatgtgcctgtaatcccaactgctcgggaggctgaggcacgagaatcacctgaacctgggaggcagaggttgcaatgagccgagattgtgccgctgcactctagcctgggcgacagagtgagactctgtct

SEQ ID NO: 9782 - DNA, 271 bp, Homo sapiens
gaggcggagtttgctgttaggcaagattctgccattgcactccagcctgggcaacagagcgagactccgtatcaaacacacaaacactccatgacatgcagtttacctatatatcaaacctgcacatgtagccctgaacttaaattttaaaaaaagaaagtaaccatttttttaaaagtttaatatttcatctttcaaatttcttgaatattcatgtatttatgtaatacatacattttataataaaaagtccttatagatagaatattta

SEQ ID NO: 9783 - DNA, 377 bp, Homo sapiens
aacagccacactggaaaaaaatcttgccatgtatacaagtctattgcacatgaaagtctactgtaaatccacatttgagtggtaaacaataatgcttatagaggaaaatgtagaagaatagcatcatgaccttgggacaggcaaagtcttcttaaactagacacagaaagtaccaatcacaaaaggaaaacaccggataactgaactacattaaaattacgaagctctgcccatcaaaagatataattcagaaagtgaaaggacaagccagcatttacagtacatatacccaaaaaagtgcccatatctgtattatataaagaactattttgaggctgggcatggtggctcatgcctgtaatcccagctctatggga

SEQ ID NO: 9784 - DNA, 456 bp, Homo sapiens
tatgtgaagttcttgttaagatcttttgccatttttctactgcattcttccttgttttccacatggattttttttaactttattacattaaaacaattaaccctcagccttcatgaactaacttttttcaggtcaactagtatcttagttcatgttctgctgctttaacagaataccagatgctaggtaatttacaataaacaaatttatttgtttcatggttctggaggctgggaagtccaagattgagaggctgcatctggtgagggccttcttgatgcatcatctcatgatggaagggcagaagggtaagacagcacacacatgagagaaagagaagggggcaaacttaccttttgccaggaacccacacccctgataagagcattgatccattcttaagggcagagccctcatgacataatcaccctcttaaaggtcccacctctcaacatt

SEQ ID NO: 9785 - DNA, 447 bp, Homo sapiens
actattcatctctgaagcaagagagaagaaactgaaacgccttggccagaagcaaagagagactcaaagcataatgagatactgctatggtttggacgtatgtcttcctccaaaattcacgcgctggaaattaacctccaaggtgatgtaatgtattaagaagcaagacccttgttaggtaataggccatgggggcgccaccatcattaatgggattaacggctttataaaagaggcttcaggccaggcacagtggctcacgactgtaatcccagcactctgggaggctgaggtgggcagattacctgaggtcaggagttcgagaccaacctcaccaatatggagaaaccccatctctactaaaaaaatacaaaattagctgggtatggtggtgggtgcctgtaatcccagctacttgggaggctgaggcaggagaatcacttcaac

SEQ ID NO: 9786 - DNA, 397 bp, Homo sapiens
catgaggaaggaaaggaataagatcaggtcaagatgagaaagtgtaatgagaaaatgccattaaaacaagaagaaattcaggtaatcattcagtattgcctattaagggtattaataggctgggcatagtactcatgcgtataatcccagcactttgagagacagaggccggtggatcacctgaggtcaggagttcaagaccagcttggccaacagggtgaaatcccatctctactaaaaatacaaaaattagctgggcgtggcggcactcacctataatcccagctacttgggaggctggagaattgcttgaacctggaaagcggaggttgcagtgagccgagatcgcaccactgcactccagtctgggtggtagactaagactcagtctcacaaa

SEQ ID NO: 9787 - DNA, 507 bp, Homo sapiens
caactcaaatgaataggctattgagcatccatgtggaggccttataagaagtcgtgatgcattaaaattgttttcagattataactagtggcaatttggaaagtggataggaactaggaggagttgatggaggaaaaaccagacaaaaggccgtttcactagtcccactagacatttggaaggcttgaaatgaagtagtgacaataaggatagagagagggactagatatgcaaattagtcttataaaaattgacttgatttggtgctttgtgagatgtaaatattgaggctgacctaaaagttgaagaaaatattgacatgtctagtatgagtgactaggtgaatggtgatgtcttttaccaaaagaaaaatttctagggtgggataggtgggttcatgagcaggatgataaattcagtgtaaaaaaatacttatttttaacaaataagccataattctggtacaaaattttaaaagtatagaagaatatatggtgaaaagtaagt

SEQ ID NO: 9788 - DNA, 589 bp, Homo sapiens
tcaagattaagctagtatggcctcagatgagaagacacatggaaacttgagaaataaaagggaaagttaatgaaagatgttagtgaaatttcattcaccagcagtaatgggtgttcatgcatgttcctaagacattacaaaagttaaaatttaaactcatatgttaattcatagagaacttgatggcaaatttaagtcttcatagcaaatttaaatattaggaaaacatgagggtatgtgtgaaggttaacagagagtatgagagaaaaaaacactgattacaaacaaatatcagcaatatagcgaggtctcattacatgtaaactagtacatgcaaagaagtataaattgttgaattgtatagctggaaatgtcctctaacgcttccctcaggtagtaatttaggtagcgacataagggattatttaacccgatcacgatcactgaagaccctgtatcaggctaaatggagtaaagatgagggctagctctataattttggattttgaaagtccatgctccttatcccttttaagatttggataagaaacagcaaaactgaaaatcggtccatctatttactctccat

SEQ ID NO: 9789 - DNA, 217 bp, Homo sapiens
taccctatgctctttgactttttggttgttacagataaaaagagattactctgctgagagtactaattttacttaaaggtccttttggtttgcatattaaatatgtcattcagtctctcccgagttaaatagagtgtgccctcctgttactttgaagttaaatgaagttattttctgttttggtgcataagtaaatataatcataacttactttctt

SEQ ID NO: 9790 - DNA, 126 bp, Homo sapiens
ggaggcttcatggacaagtaggagtttaaacagaagaaagacaaggaaagattatttcaggaagtggtgggagtaattttagcataaagttggtaatgtcagaaaagtttgtgatcgctttttctt

SEQ ID NO: 9791 - DNA, 469 bp, Homo sapiens
cagtcctgtagctcatttagagaaaaatgccaaaaagatgaaatctgaggccctgtgaaagagagggcccacggcgtggcttacggtccctccataaatgtcagcaaagtgacacctgagatgtaagtgctccttcccctctctccatcataaaaaaaatatgggtgcaggccaggagcgatggctcacgcctgtagtcccagcactttgggaggctgaggcaggcagatcacctgaggtcaggagttcaagaccagcctggccaacatggtgaaaccttgtctctattaaaaatacaaaaattagttgggcatggtgacaggcgcctgtaatcccagctactccactcaggaggctgaggcaggagcatcgcttgaacccaggaggcagaggttgcagtgagctgagatcggaccactgaactccagcctgggcaacttgtggctcatgccacaccagccgtcccaaa

SEQ ID NO: 9792 - DNA, 347 bp, Homo sapiens
cgtttctttaattctcccaataactctgtaaacgaggtactatgattatcccattttcagactgaagcacaaaactggggcacagggtcacttgcgcaggcttacacagttagtaagtggcagaggcaagattcaaacccagaccacatgacttcagagccaaagcacgtaattgtggtgcaataccacctctctagttctggaattggcactagctgcttaaattggtgggaggtgggggtggttacagttttctaatgaattaagaatttgagatattggagaacatttccagccctaacactaaaaatgtcatgaaagccatgaccttacagacaatctcctct

SEQ ID NO: 9793 - DNA, 479 bp, Homo sapiens
taattgactttatagcagtagaaataatgaaagatacatttgctttcccataaaaatgtgattttagtggagaataacgttcctgaagggatgagttcccaaatgttattaatcaatatattatagcaatgagcataattaacaaaacaaattatattcctcagtattgttcatcacaaacctatctaaattatatatcaaataatcagcaagttaatacagaaatgaatagcatatataacatttatttacttttacttagactccagggagagggaatgtgctcagttgggaaagggttgaaggagggacatgagaagaaatgagttggacataagaaatttagaggccgggcgcagtggctcatgcctgtaatcccagcactttgggaggctgaggcgggtggatcacctgaggtcaggagtttgagaccagcctgaccaacatggagaaaccctgtctctactaaaaatacaaaa

SEQ ID NO: 9794 - DNA, 103 bp, Homo sapiens
attacacagtttgtagtattttgttataggagcacaaatggactaagacaatcctcataataaccgtctgtagcaagtttcattgttgtccgcgtttgaaatg

SEQ ID NO: 9795 - DNA, 625 bp, Homo sapiens
gaattcggcacgagccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcactt

SEQ ID NO: 9796 - DNA, 58 bp, Homo sapiens
tctgcccagcactcaatatgagtaccagttctccatgtgctgctgagcttactgcatt

SEQ ID NO: 9797 - DNA, 583 bp, Homo sapiens
ggcacgagccccgcctcgggcaccgggaaactgaggctcgggcggcctgagacgccgtcaaggtcatgtaggtggtgggggcttgcatcttcgcctcccgactccatccagttcgtgtttgctgtgaagacggtaccgggtcaggggtggtgagagcgggcgggcaggtggacaggaaccccgtgcccttccctgtctgctgaacggaatgcgtggacctccgggggagcccagagtgcctcccttcacaccagtgagacgcaatttggggtcagcactcagggcaccggtggcctccagagggccggtcgatcttcgctttaactccagggtggtttccttgacgttgtcggcagtagataagaaggcctcttctgagctggtgaatctttaacctacctgaatctttaacctgcctgcggaacgacctgctcgcagactctaggccgcagaggccggccccagcgctctctcggagcacagcctgggtggttacggcgtgtgagattggggctggacagccgtgcgcacctagagtgttaaataaccattccgacggcacctcctggcactccctttcagt

SEQ ID NO: 9798 - DNA, 64 bp, Homo sapiens
atggctgcttcagggcagctgtcttttatggtcgcagctgtggggatgaaataagccccagttt

SEQ ID NO: 9799 - DNA, 469 bp, Homo sapiens
cccagagtgctgggattacaggtcttgctcttctttaagttgtgccagatatgatatgactgcatagtgttttcgtaagaataccattgggaaaatgagaagttttactgggctagttcttccatgatttgaggatgatattcagattataagataccctttgtctttcttacagtaatgaagtataagctccatatctgttccagagactttaacttgacttgcttcattcacaaagaacagagttcaagaagcagtgcatcctgtgagaagtgtgaagtgtttgtacatcactttaaatatattacttaatatattctaagttgctgtgtggagcagtatactgttgttttaaaaatgcaagattcagacaaattttaatattatctcattaaaataatttaaataatggtataaaatatctatatcattaaaataattttccatagtgtttagaaaccatgaaaaa

SEQ ID NO: 9800 - DNA, 654 bp, Homo sapiens
catggcgctggccaccgcctcgcctgtgggaggaaagcaggtgtgagggcccatcaggaggccatgccaacctctccccacagggctcacgagtcccgccccctccactcatttcccattcattttactccttattccttctacatttttaaacttcgaatttcagtgtaaagtgcagggaactgcctgcatcataagcttgatggactttcacaaaaggaacacacctgttttatggtacccaggccaggagacaggacattgctaatcccctgtagggtccctgggcccctcccagtctctaaccacaccacgctaaccactatcctgacttctaacatggactggttgtgcctggtttgtgtatgtggtaagatggaattctacagtatgtactcatttgcacctggcttctgtcacttcatactatgtgagagtcatccaggtggctgtgtggggagtagtctggtctgtctcatcgctgtatggtatttgttgtgtgactatgccgcaatctattcatcgtttctgttcttttagagacagggtcttgctctgtcacccaggctggagtgcagtggtgcagtcatggctcactacagcctcgacctcctaggctcaagtgatcctaggcatgcgctagcatgcctggct

SEQ ID NO: 9801 - DNA, 390 bp, Homo sapiens
  misc_feature (1)...(390): n = A,T,C or G
ggcacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgtgtgtgtctgttttctctctctctcttctcagtcacactttttttttgggacacaccctccatccgcgggggggtttttttcccggcgcgcgccctttttttttgtgtgtttctctgcgcgcctctcttttttctctctcttccccccccgcttannnnnnnnnnnnnnngcggggggggttttcgcgcgttcnnnnnnnnnnnnnctcttccgcccccccacaggggggtgctgtttattatctttctttctccctgagc

SEQ ID NO: 9802 - DNA, 369 bp, Homo sapiens
  misc_feature 345, 354: n = A,T,C or G
ggcacgaggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaagccacaggatcccagcccggcctttgntggactgangtggcgctgagtgga

SEQ ID NO: 9803 - DNA, 402 bp, Homo sapiens
  misc_feature (1)...(402): n = A,T,C or G
ggcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaa

SEQ ID NO: 9804 - DNA, 369 bp, Homo sapiens
aaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctcttcagtatgtgccagagcaagccc

SEQ ID NO: 9805 - DNA, 420 bp, Homo sapiens
ggcacgagcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgtttttttttt

SEQ ID NO: 9806 - DNA, 385 bp, Homo sapiens
atcgattcgtccgtgtcggggtacacccagcactttgcgacctgcggcccaacaagcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagctagaaaatgatgtatattttagtttgttgacaaataagtcatcatgatcacgaaggacactgagaaaaaataatttagaaccctggtttttgtgaatttttttggtttggggttcttttgtttgagaattgg

SEQ ID NO: 9807 - DNA, 402 bp, Homo sapiens
ggcacgaggagagagagagagagttatgatatagagagagagagagagagagagagagagagagagagagagagagagagagagagagagagagatagagagagagagagagagagagagagagagagagagagagacagagagagagagagagagagagagagagagagactttttttttttctttcttcttttcctccagctcaaggacattctctccctgttctacagctactgtttctctggactcttctcatctcctccccgcgttctttttttctccatggcggccccttcccctcctctttgatctttccttgcctggacctctcccacgacccgcttccttttctctccctattccttctccatccgccttttcctttcccttccttgtgtggg

SEQ ID NO: 9808 - DNA, 91 bp, Homo sapiens
gagcgggacgagaaccaccccaacctcatccgtgtcaacgccaccaaggcctacgagatggccctcaagaagtaccatggctggatcgtgc

SEQ ID NO: 9809 - DNA, 409 bp, Homo sapiens
ctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtg

SEQ ID NO: 9810 - DNA, 195 bp, Homo sapiens
ggcacgaggctatgcaagcagttctcattcttaatatcagctgagattggacaaactggcaactcttgcagatacttttatcatgtgtatgttagtgggactgttgatgtttagctgatttactcatactattgttgcttctcattgatggaagaatttttttttttagtgcattatcccggtcaatgtttgttt

SEQ ID NO: 9811 - DNA, 515 bp, Homo sapiens
ggcacgagaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggc

SEQ ID NO: 9812 - DNA, 602 bp, Homo sapiens
ggcacgagattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttctttttt

SEQ ID NO: 9813 - DNA, 158 bp, Homo sapiens
ggcacgaggagagagagagagagagagagagagagagagagagagagagagagagagagagagagagagagagagagagagagagagagagagagagagagcgcgcgtctgtggctctctctctctctctactctctctgtgtgtgtgctctcctctc

SEQ ID NO: 9814 - DNA, 553 bp, Homo sapiens
ggcacgagggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctgcgtggtggaggttcgccacgggccgtccagtgttgaaatgggccatgagctcttcaattgg

SEQ ID NO: 9815 - DNA, 394 bp, Homo sapiens
  misc_feature 394: n = A,T,C or G
ggcacgaggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggcn

SEQ ID NO: 9816 - DNA, 567 bp, Homo sapiens
  misc_feature 384, 476, 511, 514, 567: n = A,T,C or G
tcacacctgtaatcccagcactttgggaggccatggaaggtagatcacaaggtcaggagattgagaccatcctggccaacatggtgaaaactcgtctctactaaaaatacaaagattagccagacatggtggtaggcacttgtagtcccagctactcacgtggctgaggcaggagaatcacttgaacccaggagacagaggttgcagtgagccgatgttgcaccactgcactccagtctgggtgacagaggaagactccatctcaaaaaaaaaaagaaagaaagggacaggtattttgatcaaattaccacatgtgggaaaccggaaaaggagggcccaataaattaaatgaatagaacttctaacagggaggccggggaattngtgccttagctcagacactccatgggacactctgagtcttctgcaaaacagggacagcaatttgggtaaaaacaaacctttgcaggtgcggnggtgctcatgcctgtatcccacatttggaggctgngcngtggatatgagttcagagtcagacaccctgcccgatgtgaaccctgcttctan

SEQ ID NO: 9817 - DNA, 489 bp, Homo sapiens
  misc_feature 328: n = A,T,C or G
cgcccaggctggagtgcaatggcgcgatctcggctcactgcaagctccacctcccgggttcacgccattctcccacctcagcctcccgagtagctgggactacaggcacctgccaccacacccggctaatttttttgtattttttattagagaaggagtttcaccgtgttagccaggatggtcttgatattctgacctcatgatctgcctgcctcggcctcccaaagtgctgggattacaggcatgagccaccacgcccggcaattccttttatcttctaagaacctgactaaacacctcctccctttgagccctccatgtattgagnctatattatctctatttttccatggtttagcttagagctactgacattttactccatgagacaaacatttggcactggctggatattacttatctataggagaatacgctctaggagctggccacactacagtacttattgttctgatatgcaccctggcg

SEQ ID NO: 9818 - DNA, 572 bp, Homo sapiens
  misc_feature 522: n = A,T,C or G
ctgccaccacgcccagctaattttttgtatttttagtagagacggggtttccccgtgttagccaggatggtcccgatctcctgacctcgtgatctgcccgcctcagcatcccaaaggcttgggattacaggcgtgagccactgcgcccaggctttatttatttatttatttatttagagacacagtgtcactctgttgcccaggctggagtgcaatggtgtgacatagctcactgtagactcgaactccttggctcaagccagcctcccactttggcctcccaaagtgctgcgactgcagatgtaagccaccataacccacctctgttgttgttgtaaaggtaaaatttcagatctggcatggtggcttatatctgtaatcccagcactttgggagccaggtaggaggattgctgagcccggagtcaagaccagctggcaaatgcaagatcttgttacaaagcaaacaacaaaaaatttccaagccagcatgtggtccgcctgtatctacactttggagtanggggcagaaacctagtcagatttagatcgctaaccaatgtggaactgctt

SEQ ID NO: 9819 - DNA, 523 bp, Homo sapiens
taaggggtgagcccaagagcatcaaggctcccatcaacagccagtcctgtgagtgaggccatcttggacctgccagctcagtaaacccttttgctgaacacagcccaaggaaggaacccttgcaaaatgaaatcgtgtggtcagtttgcggggtggttattacacagcagtagatgattgaaaaggcccagtgtcttcctggggactgaaacacccacctcctgttcatgttgatacacggtgagcagcatatggatgtgggagtggtgttggttgcaggtgaggtagagaagcagtgaacagagcacgaagacctgatgttccagggtcgggagtttagacttgatcctaacagcggccataggcggatttaggcaagagagtaacgtggtcagattttcattttagaaagttactctgacatccatgtggaaaatgaacttgaaggtcacaaggctgatggagccaggaggaccatttgggaggtgattgtagtaatctacttacgagttcattacgagct

SEQ ID NO: 9820 - DNA, 229 bp, Homo sapiens
attttagaaaaaattatctatctatctatctatctatctatctatctatctatctatctaatatatatttaacctaaatagtacatactttcccccaacctttctgtatctccagagcaatagaagagatgtagtggaatcgaccagttgcctagcaacctgaaattagtgagacatcccccctttcactgatttgattttaaatcatgcttttctttctttttttttt

SEQ ID NO: 9821 - DNA, 581 bp, Homo sapiens
ttttgtcgaggatttctgcttgtttgttttgagacggaatctcgctctgtcacccaggctggagtgcagtggcacgactgaggctcactgcaacctccgcctcccaggttcaagtgattctcctgcctcagcctcccgagtagctgtgaccacaggcatgcaccaccacacccggctaatttttgtaattttagtagagatggggtttcaccatgttggacaagctggtctcatactcccaccctcggggatccaccccccttggcttctcacagtgctatgatttctcgtgtgagccatcacaacccacctggctcaacgggtaatatcctgtccctgtctgaatttgcaaaatagcccccgcggggctcttcaccctttaagcacctattcctcccggtttaggcctagaaatatttcaaacgcgtgatgttattcatcttacatgatcccccacatgccttcatcggtgggcaaagaaactttttacgcaaaacaaaaaataaatttgtgcggttttctaacccccacccacgggggaaacctttttcataaattataataaccggtgggtgcctcag

SEQ ID NO: 9822 - DNA, 503 bp, Homo sapiens
agaacaagtttaaagtttgtgggttttgaaaatactaccatggttggatgctttggttttgtgtcagcctgttcttaacctgtagtgtttaccatttaccttcccgtcaaatgtaaagggaaccttataaaacattatagacacgtatttggggtgtaccgtagagggagctgctactttggaaaggactaaatgtctttagttaaatcttataattagcttatagttttattaatttagaagtttagaattttataagttttagcataaacttgaatacagcaattttaatataaaagtattaatttgtaatttaagaacttggccgggcacggtggcttacacctgtaatcccagcactttgggaggctcaggtgggtggatcatgaggtcaggagttcaagaccagcctggccaaaatggtgaagcctcatatctactaaaaatacaaaaattggctgggcgtgcgccaccacgccgggctggtttttgtattttttgta

SEQ ID NO: 9823 - DNA, 397 bp, Homo sapiens
ccatatctccctaaagcacgaaatcctgctgaacccgcgctagttctgcccccacttgctcaacacggtgaaccagatgctcttcaccgaggtggaggggacctgcacaggtaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatatt

SEQ ID NO: 9824 - DNA, 218 bp, Homo sapiens
gaccacgccattgcactccaggctgctgggcaacaagagcaaaactccatctcaaaaaatagccgggcatggtggcgggcacctgtagtcccagctgctcaggagactgaggcaggagaatcgcttggaccggggactcggaggttgcagtgagctgagaccacgccattgcactccaggctgctgggcaacaagagcaaaactccatctcaaaaaag

SEQ ID NO: 9825 - DNA, 587 bp, Homo sapiens
cttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatacatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaag

SEQ ID NO: 9826 - DNA, 511 bp, Homo sapiens
gtctttaaaggagtggctcatctttcctctccctggggcattttggtgtgggagactacaggggatgaggttaaaaagcttggtcggcaggtagaggatggggagagaggttagggccctgggaaaggtgggagatcagccagagacaggtttcccagaacagaatgtctggcctttgtggtgaggagggactgtggtatgagccgcagaagcgggccaggggtaaaccctcctgtgcgtccttccttcagcctggtcctgagggtgaccctttgatcctgggttctccaggtagggctgtgagctgtgagttggatccttttggtgaaatggtctctctcatctggcctgtcactcaatgtggaatagagtgagtgagttctatgggttctaagtcctgctctggaaccataagtaagttatcctctctgggcttcagtttttcatggaaagttgcgttaagaatctagtttaaggccaggcatggtggctcacgcctgtaatcccagca

SEQ ID NO: 9827 - DNA, 552 bp, Homo sapiens
ccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggag

SEQ ID NO: 9828 - DNA, 396 bp, Homo sapiens
  misc_feature (1)...(396): n = A,T,C or G
ggatacgcagacaattcctcaactgcagctccctatgggggagctctctaatcatctgatggtcatgnnnnttancgccttnacccttnanntgantcatnccttatgacatgactnctgccatttatcntgagatcttttatgtngcctttgcngaatncnttnttgctgaccctcctnattgnctntatgantngccntgtgggaacctatnntatgttatnaagtnactntgngnanagagncncngcnttatnnaagattgcctttgactcattgacccatttggnggaaaaagntnanctatttgcntggntaaannatnagctnntncgnatttttctgggccncnaacaacnaanaannnacngtcgtttttcnttgnccncnnggaaa

SEQ ID NO: 9829 - DNA, 402 bp, Homo sapiens
gtttttccatgtcgtcattgagtcattcaagttttatggctctggatatttgaaattattttggacacccaaatttggaatgtttctttctgaattgtgataacgccagaaaatttttgagatcagaaaagggcagtttatttgctttaaaataatacagcttttgtaggggactcgtgatacttgggcattatttcctctccacattaaaaggaaagcagtgggcaggaaagatgcatacagcacataacctcattacataatacaatgtttctttggaaccagtaggaatgagttgttctggaaaacaatttgtagaggttttatcacttttagctctttaagatttatcacttttaggccaggcgcagtggctcacgcctgtaatactggcctttggga

SEQ ID NO: 9830 - DNA, 631 bp, Homo sapiens
aaggagtgtggcttgaagtcttttgattctctttccaatgagatgtatataattatggaactgaaaactcacaactaaatggaagtcagaagtgatcatagagtgacagagtttgccaggggtgtttagagtcagtcctaggaggcaacctttaaacatctgtgagagtgcctagaaaacagggctcaattaaaggagactcaacaaagaaataaattacataatgaaatcccagttatttgcataaatttctatactaaatgatatacagaggtcccttacttaacctgtgatttaatgacctgaagtgtacctctctaacaaattaatctcgcataaggactgtttattattgtttgctacaaaataacttctaggcctgtaattccagcacttttggaggccgaggcgggcggatcacctgaggtcgggagtccaagaccagcctgaccaacatggagaaaccccatctctactaaaaaacaaaattagccgggcgtggtggtgcatgcctgtaatcccagctgctagagaggctgaggcaggagaattgcttgaacccaggaggtggaggttgtggtgagccgagatggcgccattgcactacagcctgggcaacaagagcaaaatt

SEQ ID NO: 9831 - DNA, 612 bp, Homo sapiens
tcaccttctgtctctccagtttgggggcagctgtttgacctgtgacttaacttctcttacagatctaagaaaagttgttgatttttcagtttgtttagctttttacttgctcttaagattgagtgacagatttttttttgcatttttttattgtgataaaatgtattaatacaaaacatttatcatttaagtgtacagttctgtggcattagatacattcacactgtgcaattaggactcttaaaaggaaaaagtcacatactgttagaagggtcatacaaggctttatagaaaggatttttaagatgagcttctatatatcaattaaaagaacatttcagtagaaacatgggcgtatggtatgataattaccagaagacaaatgcaaataagtgctgaacacaggaaaaaaataatcaacctctccaataatcagaaaaattgaagttaatcatcattaactgttgggggagtagctaccaaatttgataaaaactcaaaaattcgtaataattcagaaattgagaatagcggccgggcgtggtggctcacacctgtaattctagcactttgggaggctgaggcgggcagatcacgtgagctcagaagttc

SEQ ID NO: 9832 - DNA, 511 bp, Homo sapiens
tgcatccggaaggtggaggttgcagtgagctgaaatcacaccattgcactccagcctgggtgacagagtgagactctatctaaaaaaaaaaagaaaagaaaaagaaaatatcttttcctagtttattgtaaattattttattaaaagtggatggagaattaattgtatcatcagaaaaatatcttttaaaagaaaaggtatcacaggagccatccatctcagaaaagcaaggaaaaaaaatatgagactttcaatattaaaaatgaccaaatatttaaattggcttctctctctttcttttcattaactgacgcttaccattagaggagaggtgactctagggcctagcatattgctgaaaacacagaagggaataaataaattatgtatcgtcggaggttttttactggggagagagctgtaggtaattgttgcaccacacagatgctccctccaggactgaaggacttacccctccagctgctgggattatagttggctgacactctcc

SEQ ID NO: 9833 - DNA, 168 bp, Homo sapiens
aagacgacagaagggtacggctgcgagaagacgacagaagggatgtttttgtgttttatagttacagtaaacaatttgatgtcctacttttttttttttttttttttaaaagggattttttttttgtcccccgggcggattgggggatgggggggggcaattttgggt

SEQ ID NO: 9834 - DNA, 502 bp, Homo sapiens
ctgaatgggaaagaactcagagtctaacataagatctaaaaatcaacttaagtacttttataattctaccatatttttcttattttaggcaaaggaatttttgtccattcttcagctccagttttaaggagagtagtaggaactctgaagacagaggcagcagtaatcaggggagaacgatacaaagaaatgaagctcaaaaagacagcaccagagtcctctctggccagccgcaggcctggtctatgaaaaccctgagtggttttaggcatcatttcaccatcctaagattcaaaacaaatcaagcaatcaaaggcagggctgctaagtaagcagctgcacaagcagagcagtgggagaggtgaatgggaccagggcctcgctgctggggagaggaggaaggggtgggagactagatgggggtagcaaggggacccaagggaagtccaattaaaaagttttattggccaggcacagtggctcacacctgtaatcccagcat

SEQ ID NO: 9835 - DNA, 334 bp, Homo sapiens
ggcgtctacattcacggcggtcactccgtttctgtctccttttgtttggcacctgtcagtggatggaagatgaaagtttcaaagctcatggtaacagcagggttctctaccccaggggtttctacctgtgtctggcagtgccttaagaggatgatccagaggcttcggaggagggcgacgtgggaaggagcaggtagcccaagctcccatctcccacccaatcgttcgggcagcttggatccacgtaacatcttgtcattctaaatatgtcagatttaacttggaaaacaaaaaaaaaagaattccactcctaaaaaattttactaagaaatat

SEQ ID NO: 9836 - DNA, 423 bp, Homo sapiens
ggcacgagcaggcggcagaggttgcagtgagccaggatcgcgccactgcactccagcctcagcaatagagtgagactgtctcaaaaaaaaaaaaaaaaaaaacccgcccatttttaaaactccccggaaaaaattttttcagggcccctttttataaaaaaaaagggggtttttttttttgttttcccaaaaacccatttggggcagggtttgggggccggacttttttagggcccttaataatttgcttaaggatttgaaaaacggcataaccggggcattacccccttttggaaaaggggtaaaacctttttttttttagggccttttttttttaaaaaaggggtttaattttgccccctgggtaaaaaaccctgggaaaaacccgggtaaagggggggttaacccccggggcccaggggg

SEQ ID NO: 9837 - DNA, 561 bp, Homo sapiens
ggcacgagttcatttttaaaaagcttctccttattatgttgttgtttaacaacttaaacgctatctctagaccaggaataattatttgctatatattacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggcatagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttatcaagtaaacctgtctcccatcagaaaaatggatatca

SEQ ID NO: 9838 - DNA, 390 bp, Homo sapiens
cttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaagccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaattt

SEQ ID NO: 9839 - DNA, 596 bp, Homo sapiens
ggcacgagcaacaacaaaagtaagaggagcaaacaaaatgtatcaatttcagccgaggttttctagggcaaacactagaatattgtaccttttgctacctgataccttatcaatcaatatatattactgagcacttcgatgcaaggattccatcacctccccaacatgtgatatagaatagaagcaggtaaatgtttactaaatgaaggtacacagcgggcttttggagaggaaatagactctggcctccagccatggaataatttatactgtctcttgctaacatacctggagccgtttcctcattttgtgatccaaagagtaaacatgtaaaaccagccaatcttaggttatattcttgccatcctagagagtaagtgctccaggacatcagagtaagaagtctggaccaggggcaattctctttgtataatgtggattattgtttatgttcctatcttgtttccctgttagactgtgagctggagagtttgcacttttatgtgtcgttctaacactctcagtccttacagttcactgaacccagcagccagtcaaaaatctttgccactgttgaattgtaatgctgtacgttc

SEQ ID NO: 9840 - DNA, 68 bp, Homo sapiens
gatactttccctttcagtatcaataaatatagtatcagcctggcacagtggcttatgcctgtaatccc

SEQ ID NO: 9841 - DNA, 63 bp, Homo sapiens
atgtatctgatgcagctaatgtcatggtctatgtgggaattcccaaaggacagtgtgagcaag

SEQ ID NO: 9842 - DNA, 397 bp, Homo sapiens
ggcacgaggagagagagagagagagagagagagatatgagagagagagagagagagagagagagagagagagagagagagagagagagagagagagagagagagagagagagagagagagagagagcgcgcgcgcgcgctctctagagtgtgttttctctctcccgctcatttacgcccccccccgcggcgcacccccccccgggggggggggccctctctcttctctggggggagtttctgcgcacacacacgcgagagtctctgttttttttttgcacgcgctctcgcccctctgtctctctctcttttctctctctctcgcgcgcgtgggagactctctttgcgcgccccttttctcatgtgtctatgtgtttgcgcgctatattatagagctc

SEQ ID NO: 9843 - DNA, 611 bp, Homo sapiens
ggcacgagcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatgg

SEQ ID NO: 9844 - DNA, 121 bp, Homo sapiens
tgtttttcgttggctctacaggtcttatcatggataataatgtaacactattatatactcactatgacacttttaagaatggaaaaactattgttacgcatattttatttttaaaaacttc

SEQ ID NO: 9845 - DNA, 408 bp, Homo sapiens
tatatcccctatcttccctttccactgccctcacctagtcttcaaccctgagtaatggggtgttcatagaactctaatggggtgataagatattttatagaagtagaatcttgatctgacctctccttctaattgggaacgtctatgttctaactagcagaaattcctcaaagtttctggcatatggaaaattttccctctatttttattcctttgatcatttcaatgtgaatttagaatgaggcaatttagaagcctgtcctcgcaaagccattttatttaaaaaccacaaaataacactttttttctgtgtgaagaaggttagaaaaaaaatgctcaagactcataattatatgtagttttaacattttttcataaaaggtttcaaatcccttgggaaactacatg

SEQ ID NO: 9846 - DNA, 442 bp, Homo sapiens
gaatactcgtgaataaactttgcaaaactatttgtaaagtactataaggaattctgagaagttactataagatagaaaagaatataggagcatgcccaagccatatatatgatgtttcacgtaatatgcttggtagacttgtaaaatattttagatgtggtgtaggaataaatctttgatgtaatttgtttttttgtatttgtttttgtttttgtattttgagacagaatctcgccctgtcgccaggctggaatgcaatggcacgatcttggctcactgcaacctgcaactccctggttcaagtgattctccttccttggcctcccaagtagctgagattacaggcacatgccaccacgcccagctcatttttgtatttttaatagagacagggtttcaccatgctggccaggatggtcttgatcttctgacctcatgatct

SEQ ID NO: 9847 - DNA, 58 bp, Homo sapiens
agatgttcatgaacaagaaccctcctgccaggcgcaccctggctgacatcatcatgga

SEQ ID NO: 9848 - DNA, 84 bp, Homo sapiens
ggacacagatacaggacaaaacatcagaacctcactgcggccctctgctcctctcctactcaacacttcatcagccctgatgac

SEQ ID NO: 9849 - DNA, 543 bp, Homo sapiens
  misc_feature 435: n = A,T,C or G
tacaaaagactacagaataggccaggcacggtggctcatgcctataatcccagcactttaggaggtcgaggcaggcagatgacctgaggtcaggagttctagaccagcctggccaacatggcgaaaccctgtctccactaaaaatacaaaaactagccgggcctggtggtgggtacctgtaatctcagctactccggaggctgaggcgggagaattgcttgaacatggcaggcagagttgcagtgagctgagatcgtgccactgcactccagcctgggggatagaacgagactctgtctccaagaaaacaaaaaataaaaataaaataaagactatagaatatataaacatagaaatataaaaattacatttatttctatgtataaaaacaaactggaaatgaaatttaaagataatcttttatgatagtctcanaaatattaaaaatttacacgataaatttaataaaatatatgtaagatttataccctgaacacttctgagagaaattatagagaatctaaataaatgaagagatgcacc

SEQ ID NO: 9850 - DNA, 508 bp, Homo sapiens
aaatctttcatgaagggagtgagacggctacctcttccattttatacacagagaaaattatttttgctcatctttcacctatggagtctaccactacttgaaaaccagcttccaacctctctgagttttcagtgaatgatctgaagaggaaaggactgaagcaaggaggttaggatgcagcatgcttattttcaatgtaatgtaattaattaattagaaatctgattcggaatgtctcctgtgtacatcagaataaaattactaataataaatataaaaacctaccatctctctcctcaaatactgtgtcttcatagaggaattgtctgatctactctaaaataatcagcacccaaatttattcattctctttcctctttttctcctttaatgtctttgtatttctcatctaaaattatataatttatttattcttcttatctactgccttagtcgctggaatgtaaactccatgaagactttggcattgtctacattttttactcta

SEQ ID NO: 9851 - DNA, 306 bp, Homo sapiens
  misc_feature 269: n = A,T,C or G
ttgccatttgtgtaaaaacagagggacaaagagtatgtgtgtattcgcttgtgtatacatgaaatattaccaggatacacaagacacagatattactaactacctctagaatggggaacttttgtatctttttgcgttttttgaattttgggacttgtaaatatactgcaatcaaagtattaaataaggaataaaatagttcaatttaaaagaattgagatggtactctactcatatttttctttttaaaaaattatttaagataccanagatcagcattcactaaatggaattaaacacactcag

SEQ ID NO: 9852 - DNA, 425 bp, Homo sapiens
gccgcatccacagccgagggcactatggcttctggagttacagtgaatgatgaagtcatcaaagtttttaatgatatgaaaggctcctgaaagtgcacctttaaaaagcaagatgatttatgctagctctaaagatgccattaaaaagaaatttacaggtattaaacatgagtggcaagtaaatggcttggatgatattaaggaccgttctacacttggagataaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagc

SEQ ID NO: 9853 - DNA, 164 bp, Homo sapiens
aggttccccttcggctacaggaaggcaggaggggtgagtcccctactccctcttcactgtggccacagcccccttgccctccgcctgggatctgagtacatattgcggtgatggagatgcagtcacttattgtccaggtgaggcccaagagccctgtggccgcc

SEQ ID NO: 9854 - DNA, 371 bp, Homo sapiens
agcgacggtagctctagccgggcctgagctgtgctatcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagataaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggact

SEQ ID NO: 9855 - DNA, 514 bp, Homo sapiens
ggcacgaggtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatt

SEQ ID NO: 9856 - DNA, 396 bp, Homo sapiens
ggcacgagggacagcagcttttctgatttacagagttcttcagatttacaaatggacaatgacatcacagtttttagcactgaagccagtctcatgctagtaacagtgggtgagccgctcgagggactgggttctgatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttaaccaaggaagctggcttttgtgtcgccactt

SEQ ID NO: 9857 - DNA, 143 bp, Homo sapiens
tatgagattttttccagcctgtctcttaaactcctgtgacatcttcaatgatatgtgccctcagttgcagcatagcttctctgctgcctattgccattgctgtctcaaaagttgagtgaattttgaggcgtcttttttttttt

SEQ ID NO: 9858 - DNA, 111 bp, Homo sapiens
gctggaggcacaggtggagggcagggaataggaccggcaaatctatagaatcctaaagggagccaagagaagccacatgcaaatctccctccctccaaacaattctccctt

SEQ ID NO: 9859 - DNA, 203 bp, Homo sapiens
tagttgatgtgcccatctgccccacctctgcctggctgtacttgtagctagtacatgtatactatatatgtgcccgactgtttcattgtatgttccaggatggtcatgcctgagttttttttttttttttgggggggggaaatttcccttttttccccagggggaaggggggaaaaaaaaaaacggttttaaaccctaaaacc

SEQ ID NO: 9860 - DNA, 615 bp, Homo sapiens
ggtccaccccaagtctggcttctctcaggagggactcatgaacacgtgccctgagcacccccaaaatgacatcacacaagggcagaaaggagctgaagggggaacgtgaaaggcagaaagggagccgtggttgccaggcaaccagccctagcccacctttgtttgtttggtgacagcaactaaggtctggtcagggccgcttggccacgctcatgccttttcctctcaacagttgcttctttgagtcagggtgcagctctggtcacctggcggcctcttcagctcagccctccacaaagtgtgagcctgaaggaccaccctgaattgcccttgtaggacccagaacagctaccagcagaatcagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgcgaagcgggtgaagaggagtgacctgacttgctggggactgagatggcagcaggggaggcgagctgacctgcccccat

SEQ ID NO: 9861 - DNA, 327 bp, Homo sapiens
gattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttattttttccttttttcttttttaagagacagtcatccaggccagagtgcagtttgatgatagcttgctgaagcttcccactcctgggctcaagttatccttccattttggcctcctgagtagctagaccataggtatgcatcaccaca

SEQ ID NO: 9862 - DNA, 656 bp, Homo sapiens
cgcgtggacgcagcttgatgggggagaaagagctctgggagcagggcttagagcctcgtctcgcctcctgccaactcggtccggcaaggttccgaacctccctgagcctcagcttcctaatctggcaaacatgacgacaaaagtccttctcttttaaggttggtgcaaaaattaaatggccctttactgtatatttagagcacctggctcacggattagtcacctcgctcctgggctcaacagtgttcactgggtccttacagcatcacactgggatccttaagggcaaagaccaaaattagacctagcttaattcctggtgtgcaagtgctaagtgttatgaaatgagtgagtgacaggatgatccagctatgagaaataggagagagtttgcggtgggatagagactgtaccttctttttgtataagatgtttggcagttggggataacttaccggaagcaagcttaagatgcacacgaaatcctgaccaagaggatgtagaaattagatatatggccaagaatcagagaagcaaataaacagatctcaataaaatgtttagtttcgaggttagaggtgggatatcagggtaaccaggcaaaataactgatacaataaataactacatgacaaatcacttctctcacaacacat

SEQ ID NO: 9863 - DNA, 238 bp, Homo sapiens
ggaaaaacaatacaaatacaaaccacaatgcaaaataaatacaaaacagtacaaaaacaatacaaaacaataccaaaaaacaaaaaacaaaaaacaagcctcagtgactgtgggaaagtggcaggaattatctagaattggggtctcagaagaagagagttgggaaaaggcctaaaaactatatttaaagaaataatgggccgggcgcggtggctcacgcctgtaacgccaacacttg

SEQ ID NO: 9864 - DNA, 367 bp, Homo sapiens
tcctgccgagaggtagaataccgatgcattacagatagtagaagaaaaacagactttcaaatgcagtcatgcagtgcatggtaatattttggtcaacaatggatcacatatatgatgtcagttccataacattaaaatggagttgaaaatttcctatccctagtgatggcagcgccattgtaatgtagcacaatgcattattcacttgtttgtggtgatgctggtctaaacaaacctactgtgctggcagtcatttaaaagtatagcacataccattatgtacagtacatactatttgataatgttaatatacgactatgttactgggttatgtatttactataatgtactttttaattgttatttt

SEQ ID NO: 9865 - DNA, 435 bp, Homo sapiens
agatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgcgctggttatttccagaaagaagataatggcaaagtatgagaacgctgagataaaggagatgggtgagatgcatagggaactcaatg

SEQ ID NO: 9866 - DNA, 574 bp, Homo sapiens
tagtatacatttagtatacatttatttctctctgctcgtttttgctaaggacataatacaatagaaaatagtaagaaggttacgaaagatggagctataaagttgggtggtctagggactttaggactcaggaacaaacaccacagatgatgacccctccacccatcgtgtcagtgggaggagtggcatcaaatgacccaggacagcattgccctcaccctctggtgtggtggcagtagagactgcagggactgtagtcttacaattacagcccaatgatggcaagttgaatccattctcaccccaagtaggaattggagacagaatctaagaaagtagggagctagagaaaatcacctgaataggggccgggcacagtgcctcatacctgtaatcccaacactttgggaggctgagatgggcagatcaccggaggtcaggagttcgagaccagcctggccaacatggagaaaccccatctctaataaaaatataaaaattagccgggcatggtggcatgtgcctgtaatcctagctactcgggaggctgaggcaagagaatcgcttgaaatgc

SEQ ID NO: 9867 - DNA, 462 bp, Homo sapiens
ctcgtacttctttatactccttggctttattcttcttccttgcaaactgacttcctccatgtgatgggaaacatggctaatgatggggttcaggacacactatcccaaaacatggggccttagcatttgagaaaaccacagaagcaggaagtttactctctgaccttcccctcacccctatcccctaaatcaggtcataaaacctaggaaggatcctctaaccttcccctgaagcaagtcataagatcctcattcaagaagtgccctccttgtatctataaggaacattgtcgggctgggtgcggtggctcatgcctgtaatcccagcactttgagaggccaaggtggggatgggccacttgaggtcaggagtttgagaccagccaggccaacatggtgaaaccccgtctccactaaaaacacaaaaattagccaggcatggtggcgggtgcctgtaatccc

SEQ ID NO: 9868 - DNA, 508 bp, Homo sapiens
agtgctccctcccaagcaagcccttgagcccctcatctctggaggcttctcctccatgctgcctgcacccccaccagccaccagaaccccttcaggtatagacagaaacagattcagtcaaattccttggtgtcccaggtgacgtctggccaggggagccagcccctttaagttacactattgcatggctcacacccggaatcctagcactttgagaggctcaggcagaaggattacttgaccccaggagttccagaccagctggggcaacaacatagtgagactctatctctactaaaaatgaaaaaaaagattagccaggggtggtggtgtgcacctctagtcccagctactcgggaggctgaggcaggaggatcacctgagcccaggagtttaaggctgcagtgagccgtgatcgtgccaccgcactccagcctggacaatagagtgagaccctgtcttgaacgaacaggccaggcgcagtggctcacacctgtaatcccaggac

SEQ ID NO: 9869 - DNA, 457 bp, Homo sapiens
cgtcccccaggctggagtgcagcggcgcgatctcggctcactgcaagctccgcctcccaggttcatgccattctcctgcctcagcctccctagtagctgggactacaggcgcccgccagacgcctggctaattttttgtatttttagtagagatggggtttcaccgtgttagcgaggatggtctcgatctcctgacctcgtgatccgcccaccttggcctcccaaagtgctgggattacaggcgtgagccactgtgcccggccaatcctgacaatcttaaatgtggacttaattcttcaggtggtctgttgcgttctatgatcttgttgctttctagttaccattttttatatttattttcatttgcttctcttctctttctgctggtttggaaattagatgttttacttctggtctaaggttaagaaggacatctatttaaagtccaaagttggcc

SEQ ID NO: 9870 - DNA, 113 bp, Homo sapiens
aaaagaaaaaatatggccgggcgcggtggctcaagcctgtaatcccagcactttgggaggccaaggcgggcggatcaccaggtcaggagatggagaccatcctggctaacacg

SEQ ID NO: 9871 - DNA, 546 bp, Homo sapiens
catgaggctcatgagggtcagaggttagacacttacttctaccttccctcctaatattttaataattagcagaacaaggccgggcatggtgacccacacctgtaatcccagcagtttgggaggccgaggctgggaaatcacaaggtcaagagatcgagaccagcctggccaacatggtgaaaccccgtctctactaaaaatacaaaaattaccggggcatggtggcaggcgcttgtagtcccagctactcaggaggctgaggcaggagaatcgcttgaaccccggaggcagagattgtagggagccaagatcacaccactgcactccagcctgggcaacagagcaagacactgtctcaaaagaaaattagcaagacaggctgggcacagtggctcacacctgtaatcccagcattttgggaggctgaggagggcagatcacgaggtcagttctcgagaccagcctggccaacatggtgaaaccctgtctctactaaaaatacaaaaattaggccagacgtggtggctcacgcctgtaatcccagca

SEQ ID NO: 9872 - DNA, 450 bp, Homo sapiens
tatttagactactgaacctacacaggaattgggtatttacttttagaaatcagtgtccatctagtcagagcccaagtggaaatctcttcagattacctatcgaatagatatgaagagatatcgaataggtatgaatacatgtcaaatcctgtcttgacatgtattattgcaaataaaacttagagagctagtgccttactcattccaagcttagatatcctgatctacaaagtgtggttaatacgaaggttaaatgtgataatgcatgtggagtacttatcatgatgtctgctgaagacagtagtgggagttttatttgtttaccactgtattttcttcttctgttctactaccaagtgttgagagaatccctgtggaaacttacataatattttttcctctagacagacagacatgcacacctacccacacacacactcacacatacat

SEQ ID NO: 9873 - DNA, 418 bp, Homo sapiens
agcctgaccaacatggagaaatcccatctctactaaaaatacaaaattagctgggcgtggtggcgcatgcctgtaatcccagctaactcgggaggctgaggcaggagaatcacttgaacctgggatgctgaggttgtggtgagccgagattgtgccattgcactccagcctgggaaacaagagcaaaactccatctcagaaaaacataaaatgaaaaaattaaaataaaaaaagtaagtaactaacttgcacacagatttatagtcaatcagtatatccagtacctgggactcaatccctacggctccgagacgacgacagaagggagcctgaccaacatggagaaatcccatctctactaaaaatacaaaattagctgggcgtggtggcgcatgcctgtaatcccagctaactcggg

SEQ ID NO: 9874 - DNA, 471 bp, Homo sapiens
ggccaaatgtactatacagagcatctggaagaaagtattcttagcagaagaaagagaagtgcaaaggccctaaagtgaaaacacaccggtaatactcaaaggacagcaaagaggccagtgttaaatgggaaagggtaggaaatgaggtcagaagtagcacaggatactctgggccatcacaagggccttgaaatttgtctcaagtgtgataggaagccactggaggcttatgggtaagaaaatgggagaaatattatctgatcagaaagcagctgaagttatttgtataatagcagggtttgggagagagaggaaaactctgagctagttattaaagtcttgataatgagggatgactgggggatgggtaggtgagagcaatgagagacacagggtggcacagctaagtagaataggtctgaaagaagctagcactcaatctactagcactagtggattacatttatgcct

SEQ ID NO: 9875 - DNA, 464 bp, Homo sapiens
gaccacagaagggggttggaggcggaatactgggttttgctgcaaccggtttattttccttctgttttcacccattctggcacaatctggcgccatcgtccttcttgtgaggccaaccctgaaaatgcgaagcagatattctggaccaaaattgatgcgaatccaagaacctgccatgggtctccgggtgcggtctctgaaactggaggatatcgggaggaaagggtatggaagatggataaaacacggtgccttatgtgtgttgaagacatagtcgggccaaaaatatatgatttactgaaatgcgtgtcgtgttcttgcgctttatcttgcatctctccgatgcggagataatggggaagctcttggcatggttggctgtaagtatgtgataccggatgagcaggagtcaaatacgatgcgccgacttttaattcaaggaacccttttctgaaacactttgc

SEQ ID NO: 9876 - DNA, 373 bp, Homo sapiens
gcagatttaaaataaggccaagagctttagaattattttctggcttttccttctttgcattagtttgtttcttagtttgttttttaattgagacaaggtcttgctctgtcatccaggctggagtgcagtggtgtgatcatagctcactgcagcctcaaactcctgggctcaagtgatccttccatgttagcctccttagtagctgggactacaggtgtgcatcaccacacccagctaattttgcatcggttttacagcacggagtttaccatcaacatcacactccttggaaacaattatttatatagctttaagtaaactaaagtattatgggtatgacactcttaaatggtgagtgatatccttgtatttc

SEQ ID NO: 9877 - DNA, 126 bp, Homo sapiens
ggatgctcaacctgtgtagatttatcatttttaaaaatgcttccatctttgaaggaactttcatgtaatcctgttcagaagaatgtagaacgaaatttaaggcaggttcttcccataccttcatct

SEQ ID NO: 9878 - DNA, 314 bp, Homo sapiens
gtctgtgtaagtatactctatgatgtttgcccaacaaaatggtctaatgacacatttctcagaatgtatccccatcactacgtaatgcatgactaaataaataacatgaaacacctttgagaaacaagtctatgtctaatttatccttgtttgatttgtggcctcaagcacattaccttgtacatagaaaatgctaaatagctattgctgattgaatgtattcatgaatgaataagtgaagtttgaagtgatgacaagagatacacaggtttgtttgctttctttttaagagtaaaataatgcaatggaatatt

SEQ ID NO: 9879 - DNA, 463 bp, Homo sapiens
gcatggatattcatgacagctttcatttaaaaaaaagaagcttcaggagagtcattaagagttaggagcatattaataatagaagacctaaaatccatctcagttcaagatagatcaactggacaaaaacttcagtaaggctattgaggacctagattaacacaactgaaaggtagatcttagggtcatctattgcatataagagaatatacatttttgtaaatgcgcatgggatgctcatgaaagatgattattgaggtacaaagaaaactcttaaaaatttctcccaggccgggcgtggtggctcacgcctgtaatcccagcactttgggaggccaaggtgggtggatcatgaggtcaggagtccgagaccagcctgaccaacatggtgaaatcctgtctctactaaaaacacaaaaattagccgggcatggtggcgtgcgcctgtaatcccagttactca

SEQ ID NO: 9880 - DNA, 517 bp, Homo sapiens
tctgaaatgtaaatgactaggtagaataactcagagagaactgaagagagctgggaagtgggtgagattcctgagaagaggccctcagaaacagagtagaagtgactatgtgatacatgcttgataaagctccttgatccatccagcccctagttgttcatagccttagagtaggcagggagtgcagccaatggttttacacactcgcggcagaagttttgaggcagtggagaaagccagacctggagcaaatgatagcacagcagcaatctgtagggattgatgacccaggactggcacagataactgatgtcacagaagatgcctgcatagtcaggtgacagtcaggaaccagacatcactgtgccctgcaacatgggctaaggaatttagccaccatcctggggaaaagtggcagaaccttaaataggttgacatttttgttcctgttgttaggtaaaaattataggaaactattgttgtggactaaactcctgcactaagccccaacagatca

SEQ ID NO: 9881 - DNA, 597 bp, Homo sapiens
tgaataagtctcaggagatctcatggttttaaaaaggggagtttccctgcacaacctctcttgccttgtctgctgccatgtgagatgtgcctttcaccttcggccgtaattgtgaggcctccccagccaggtggagctataagtctaatgaacctctttcttttgtagattgcccaatcttggaatgtctttatcagcagcgtaaaaacagactaatacaaattcttactgatacttgtattctcttttaatcacaaaatagaacatttcccagagaagaaaatactatttcaagaaaatactccaagaatgtttctggtcatcctaaagtgatgttaacaatgacttctttatgtaaaaaatccctttctcaaactcataaactatgtaaatatgtatgataaatattaccttctgtgctagaataatagataataaaagatataatcaaaaataatacaaaaaggtcaagaatgcatcagaaaacttctttagtgacagatgctatctgaggaaatttttttattctggcatgaagagcccactaaaagtaacagacatggccaggcgaggtggctcacacctgtaatcccagca

SEQ ID NO: 9882 - DNA, 525 bp, Homo sapiens
acgacagagggcttgtccccaaaacataatttccctgctgtatttatctcaatggaatttagaagtagcgtggattatgtcaccctgagagttatttcttgtgtccactaaaagagaaaatgcacagaagaacgtgtctatcttaccgagaccactcatacagtgttggcaagaggacagtccccagagtctcaccatataatgaagctaatcactctatgaattatcttaattgaatttgaatgtattgctactgagtactatgggaagagcggccagtaaggacgcggtattttcccacagcattcagttagcaatgcattcaaatttaattaagatcattcatacagtgattagctttcttcgacgacagaaggcactggggatgtccgtgctacagttgcctgcttttggtctgcctaagataggcatatctactttcacaggttgtctcttgtattgagtacaggattgtttgatccatccttaagtattatcctgagatgtgcttttcattttggaatc

SEQ ID NO: 9883 - DNA, 144 bp, Homo sapiens
gtttgggaaccatagatttagttcatgtttctgaccctatagagagttaacaaattgatgtctcctaaattttcagtaaaactcagaggaactcctcccactgccattgtttgtagcttttaccagcgtgaacctacctgtgtt

SEQ ID NO: 9884 - DNA, 349 bp, Homo sapiens
aaatattgtaagattccacctccatgtactcttgcagctggaggcttgtcccagagctcacccagatggttttggcataaggctgcttgctcactgttcaaaaatatgacctaaaactgacagctaacaaagacattcagatctcactgctgctcagggctgtctcatccggcttctcccctgccccctcctttgcttccttgctggcctttgaccctgctgacccctcagctactgccctatttattgctccttcatctgagttcaccgccggagtattcgaacatgcctgcatttcctctcaacctacactgcctctgattccctagtatctggcttcatctttcta

SEQ ID NO: 9885 - DNA, 82 bp, Homo sapiens
ggaatcccacagccgagctataatcactatgcccaataccttgctgattccttcgctggggctgcctgataacatcacaacc

SEQ ID NO: 9886 - DNA, 567 bp, Homo sapiens
tacattttattgtggttggagagatcaaaatgcctaagactgtggtctaaagagaagccatcaacatgtacactgagaagctttcctttttagagtccattacagtatccttgctctttgagttgttccttcttctaggtactcataagtttaatatttctgagtctaactctattacaagctctatgatgaagttcaaccatggagtcatgaaagatggcttcaccattattgatatcaaaatgataactagtgatattctcgtcatattacccaaataaaattgtataaaccaggcagggcgcggtggcacacgcctgtaatcccagcactttgggaggctgaggcgggtggatcaccaggtcagaagtttgagaccagcctgaccatcatggtgaaactctgtctctactaaaaatacaaaaattagccaggcatggtggcgtgtgcctgtaatcccagctactcaggaggctgaggcaggagaatcatttgaaccagggaggcagaggttgcagtgagccaagatcacaccactgcactccagccagggcaacagagcgagac

SEQ ID NO: 9887 - DNA, 344 bp, Homo sapiens
taaacaatttagaaagtcatcttgggcccattggcagtatgtatcccattttgggaaaactggagtggtcaaacaagaacatttggggcaaatgggatgctttggcaggtcctaagagtggggaagctgaggcagctggttcagtgtattgctatgaactcatggaatatacacagcagagccaacctagagactgcctggaggaagcttcagaactaagcagttttgcctcttgtgacaaaagtatcctttgtactcccacgagaacacatcgaataagttaaacagactgagattgagtcagagattttccacctaaatactggcattatgcttacacaagt

SEQ ID NO: 9888 - DNA, 539 bp, Homo sapiens
tagagatggggtttcgcgatgtgggccaggctggtctcaaactcctgacctcaggtgatctgcccgctttggcctcccaaaatgctgggattacaggcatgaaccacctcgcctggctaataaataattttaaaagtgactattgtagagcgagactctgtttagaaataaaatacgatagaagagagaaggataagtttgttgtggacagtatttgcaaatgtggaataaaaatgctgggccctggaacttaagtgaggttgggaagtgaagataagagaagagagaaatggtgtcagatacagttgaagaactgagacagtgggagttcttgagtaagtgagctggaaggttaggaggtcatcagagaggcttcaaagaagctgcgtgtctgaaggaggagaggcaaggaacagtttggaaatggcaagtaggaaacctactataccccctggcccttaggagcctgaaatgtcaggggaaaagtaaagcagcttctacctcagaggactgctcaggagatgggctgctcagggaca

SEQ ID NO: 9889 - DNA, 600 bp, Homo sapiens
cgtggggctcagcccaacctcgaagcgctgagaaggcgcttccaaagtgatatccctggaatgatataatgatttccttaatacgtgagcatctttcaaaactaggaggatctggaattaagtttagaagtattaatcaaactcatgccactgacgtttctgtgtgtcaagaagtgcatgcatatttggtatttaacttcagcattttttttttgtttaaaagactacggccggccgggcgcggtggctcacgcctgtaatcccagcactttgggaggccaaggcgggcacatcacgaggtcaggagtttgagaccagcctggtcaaatggagaaactctgtctctactaaaaatacaaaaattagctgggcgtagtggcaggtgcctataatcccagctactcaggaggctgaggcaggaagatcgcttgaacccgggaggcagaggttgcagtgagccaagattgtgccaatgtactccagcctctgggtaacagagcaagactctgtctaaaaaaaaaagagccgggcacggtgactcatgcctgtaatcccagcactttgggaggccaaggcaggcagatcacatgaggtcaggag

SEQ ID NO: 9890 - DNA, 629 bp, Homo sapiens
gcagtggcgtgatctcggctcactgcaacctccgcccccaggttcaaccgattctcctgtcccagcctcccaactagctgggattataggcgcccgccaccacgcccagctaattttttgtatttttagcagagatggggtttcgctacgttggccaggctggttttgaacgcctgacctcatgatccaccagcctcggcctcccaaagtgttgagattacaaacgtgagccactgcgcccggcaattctaattattttcttaaaacacatctaagtcttaaatttttacaagctgaagacttgaggtttcttatcattcaacttgcatgagggggaagctttcagatgaagcttttctctgcttggagaaaaagctgttgctttcaatcctgccaggttctccaggtcaagttctctgtatttcctcctgatcatcacgctgatgtttctggctactaaggagctgggggtggcgatgagtgacgcagatatgaatcagactgattttcaagcagcagagtttaaggaaaatgaaagaactaggcactggaagtgactgattgctggccgattcattgttgtaatgataagctggtactggacaagtgatcacaggcctgatttctac

SEQ ID NO: 9891 - DNA, 512 bp, Homo sapiens
aatcccagcactttgggaggctgaggcgggtggatcacctgaggtcaggagtttaagaccagcctggccaacatggcgaaaccccgtctctactaaaaatacaaaaattagctgggcctggtggtgcatgcctgtagtcccagctacttgggaggctgaggcaggagaattgcttgaacccaggaggcagaggttacagtgagctgagatcacgccactgcactccagcctggccgacaagtggaaactccatctcaaaaaaaatagaatacaggtgggtttacaaaataattttatgaggaaaaagaccactaagaccataaaggaaaatactgccaagtttgacaacataaaggattttctaaggcttaaaaaaaattaataatattgaaaggcaaacaaatgggaaaaacatatgcaacaactgacaaagcattagcagtagttctatatataggaagtatatgaataggagtaaaatgaccaataaacatatgaagagatttcaatca

SEQ ID NO: 9892 - DNA, 669 bp, Homo sapiens
tgatctcagctcactgcagcctctgccttttgggtttaagcaattctcctgcctcagcctcctgagtagctgggactacaggcgtgggccaccatgcccagctaatttttgtatttatagtagagagggggtttcaccatattggtcaggctggtcttgaactcctgacctgaggtgatccacccacctcagcctcctaaagtgcttggattacagacgtgagccaccatgcccaacctaatactatgaactttctaagaaataataccaattatccccaatctattctaaaaacttgaagaggaaggaattctccctaattcattgtacactgatagtggggtaatgctggcattaccctggtatcaaaacagacaaggattattctgcattatcctgctatcaaaacagataaggatgccacatcaaaaagacaactataggccaatatctctgatgaacatagatgtataaatcttcaacaaaatattatcaaacagaatccaacagcacatcaaaaacaaaacaaaaacaacaacaaaaaaacccacaacatgttcaagtgggatttatcccaggaatgtaacaacggtttaacatctgtaagtcaataaacgtgatccatcacattaacagaatgaaggaccaaaactatatgatcatctccat

SEQ ID NO: 9893 - DNA, 687 bp, Homo sapiens
tagatgcacgatattacttctgaacaagagaaagaaactggtaggaaaatttattttaaaagtgttgaagggaaagaatcaagaccacagatccagatccggagattattttgctaaagaatagcaattgtgaggcatgaagtgggaggggggaagaagctatgaacttaattttgaggtttctgagaaggaagcttgagtgaattcacttcagatgcatttggaatgtttgcactccagaagatgagattgtgtgtgctctggagagtattggaagaaggaggtattactagatttggcgactcccacagtgactcattactcttctctgttactttcaggattcatagagatatgttttgttgatattatttatttaagtgagataaatttgaatatgaatccattggcttttttttgtaaaatttctgctttataaaatctgttagaaggctgggcccggtggctcatgcctgtaatcccagcactttgggaggccaaggcgggcagatcacttggggtcagcagttcgagaccagcctggccaacatggtgaaacccagtctctactaaaaatacaaaaattaattagctgggcttggtagcacatgcctgtaaacccagctactcaggaggctgaggcaggagaattgcttgaacccagggggcagagactgcagtgagctg

SEQ ID NO: 9894 - DNA, 486 bp, Homo sapiens
cctcccaaaatgttgtgattacaaatgtttgcgccaccatgcccggccattgtagtcatttatcctggtggattaaaactgaaccagggaggtaccagtcagtggcttcgttatcatcaaattgatgactaaggtcaaccttttagaatcttctagaataaatatgtcttacacctctaaccaaatacacaggtttttaaaaaaaacaaatctataacataggccgggcacagtggctcatgcctgtaatcccagcacttttggaaggtgaggcggccgcgtcacctgagagcagaagtttgaggccagcctgaccaacatggagaaaccctatctcaaaaatacaaaaattaggccaggggcggtggctcacacctgtaatcccagcactttgggaggccgaggtgggaggatcacgaggtcaggagatcgagaccatcctgggtaacacagtgaaactccgtctctactaaacatataaaacat

SEQ ID NO: 9895 - DNA, 501 bp, Homo sapiens
agccgggtgtggcagcgtgcacctatagtcccagctacttgggaggctgaggcaggagaatcacttgaacctgggaggcagaggctgcagtgagccaagatcacactactgcactccagcctgggcaacatagcgagactctgtctcaaaaaaataaagtgccagtgaagaacaaagggccaaggaaccaaaggggagcaggtaccctgggcagacaagttggctggtgagaaggtcagtaaggctacagcactatgggaggtagtaccaggactttcttgcatggcaaaaggggtctctcagaagcctggtgccaatgtaacgaaagcctgggggagccagggagacaaaagtggaggctgggacaggcatggtggctcacacctgtaatcccagcactttgggaggcagaggtgggcagatcacttgaggccaggagttcaagaccggcctggccaacatggtgaagccctgtctctagcaaaaacacaaaaattagct

SEQ ID NO: 9896 - DNA, 435 bp, Homo sapiens
gtgggagactttcttgtggatcggggtgacctttacattcattagatgccagtaaccacccctcctgccacacctccagttatgacaacccgaaatgtctccagaatgactccaagggacaaaaatcacagccccttgagaacccctgttctagacagatattggcccacccacctatggcacgctgcagctgtgaggcagatccagcaccgttgggcaggtctccactggctctgcagactcttgagtgtttcacctgaaaaaaacaaactggataggtcacgggtggatcgcctgagtccaggagttcaagatcagcctggggaacatggtggaacccctctctaccaaaaatacattacctaactggacatggtagcacttgcctgtagtcccacctacttgggaggctgagttgggaggatggcttgagcc

SEQ ID NO: 9897 - DNA, 386 bp, Homo sapiens
cgttcgctaccacgcccggctaatttttgtatttttagtagagatggggtttcaccatattggccaggctggtctcaaactcctgaccttgtgatccacccacctcggcctcccaaagtgatgagactacgtgtgagccaccgctcctggccaggttatgaattcttaaaaaaagaaggcaaaggatctagactttgtttttaaagttatctttaccgctaggactaaggcaggaggtctgtttaagacaagccaatctcttcttgttatcatctatccgccaaagacatcaaagttagtggtccaataaaaatcatcccaataatttcatcttttctgcaaactgatgtatccccactcaatacctagaacaatatctgggatac

SEQ ID NO: 9898 - DNA, 212 bp, Homo sapiens
gaggctaatgcagtggttcaggtgagcagtaaagagtcaagaacaagaacagaatcaatgggaaagagagctctgcttggctgggcacggtggctcacgcctatactcccagcactttgggaggccgaggtgggtggatcacttgagatcaggagttcgagaccagcctgaccaacatggcaaaacccgtctctgctaaaaatacaaaaatt

SEQ ID NO: 9899 - DNA, 65 bp, Homo sapiens
tttctctcttcttcctcttctaaattttgaattgctttatcctttacttttccatttgaaactca

SEQ ID NO: 9900 - DNA, 574 bp, Homo sapiens
ggacgccgaggtgggttccgggagacccgcgggtctggctgcgagagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgatggagtctcgctctgtcacccaggctggagtgcagtggcgcaatctcggctcactgcaagctccgcctcccaggttcatgctattctcctgcctcagcctcctgagtagctgggactacaggcgcccgccaccacacccggctaatttttgtatttttagtagagatggggtttcaccatgttagccaggatggtcttgatctcctgaccttatgatccgccctccttggcctcccaaagtgttgggattgcaaggcgtgagccactgcgcccagcctccaggcctcagttttcttatgtgtaaatggggatgataaaacccggacctgcctatgaacggttcagttggatcaaagtagaatgagtgcagaagaagaagcatgat

SEQ ID NO: 9901 - DNA, 555 bp, Homo sapiens
caccacgcttcctgtacagtctatggaactgtgaacaaattcaatctcttttctttataaattacccagcctcaggcatttctttatagcaatgtgagaatgaaccaatacagataccagcaccaaagtgcctaccgtgaactttttcctacccaggaaaaaggaattctttattatcatcagcctctaaaacagggctttctgttacttgcctctgtatgaactccaaactgacacgctatctaatttatgctgagagcacagctagggaacatgcccaggcatgcggcttttacctactgagctggacaagattgtggaagtgaaagtaaaatttgaagattggatgaaagatgttaaaatcatgggaaggctgactaatttgagaatactcagacatctcataggtgaggaaaatgacagtattaacattaatacaaagaaggtgatcagtcaaaacattcctcacgagaaaaggtcctttggcaaatactttcctttaaagtaaatgaatataacaggccaggcacagggctcacgcctgtaatcccagca

SEQ ID NO: 9902 - DNA, 460 bp, Homo sapiens
aacagaagggtacggctgcgagaagacgacagaagggtacggctgcgagaagacgacagaagggtacggctgcgagaagacgacagaagggtacggctgcgagaagacgacagaaggaaggtgaccaactttgctataaaggtgttggaagtaggaagcattccaacttcctactgaggaaggttataaaatctgtaatgctagagatcttttcaggagccaccaaattgacaactatatatttgtgaatagtttaaaggtacagttttgcttacaataaggcaacaggactagttaatttatagttgtgacttgtgtgggtttttaatgatttttatgtttttaatgtgattttaatgtgattaataatatcttggctaaaatggatacagtgacaaatagtatataaaaatttgcagccgggcgcagtggcttatgtccgtaatcccagccctttggg

SEQ ID NO: 9903 - DNA, 541 bp, Homo sapiens
ggcacgagcagaagggttggaagttgagcctagaacagtcaggggcttaatggtcacacagcaggatctgcggtttggggcctagggactggtagtgaaaaaaaaaacatggaactagttctgatgtctggactctagtcactgccttgcttcgtagccttgggcaagtcttttgtgagacagggtgatagaatgaaaagtcttgtctttggagtcaggaagacccagatctgaatctagctctgatttgtactagctatgtacccttaggccagttactattctgtgtctcagtttccttatctgcaaaacaggtaaaaacaactttctcagaatatcagagataatgtgtaaagtgtttatctctgtggttggcagtactcaataaaaggtaactaaatcatttatgtcttccttccctagattcttatgtatgttaaattagaatagatataaatgtactaagaaaagttaaaagcggccgggcgtggctgtaatcccagcactctgggaggccaaggcgggggcagatcatttgagg

SEQ ID NO: 9904 - DNA, 52 bp, Homo sapiens
ggcaggctcacccagaacgctctggacaggtcagtgaaaatgggagcttcgc

SEQ ID NO: 9905 - DNA, 486 bp, Homo sapiens
ggcacgaggctcggcctgcaaggctgttgtttcaagaaatgaaaatgaagggcgccctggaataggttcgccgaagagagagcttgcaggcctctgggaagcaagccatcgtgtggcagaggcccaggtggcaaggaaccaagggcggcttctggccaacagccagcgaggacctgagaccgtagcccaacacccctccaggaactgaattttgccagcaaccagtgagtgaccttggaagtggatccttcccccgaaagcccggctttcagacggaggctggtgggacctcaaccccagcttgtatccaggctcttgacaccatctggagaaggaattcaagagtgtgtcagaaaatgatgaaagtacaaagatttattgcaaagcgaaaaatacacactcaagaaaggggagtatgggtggactcaagacagagtccgatgggacttggggtttctaccttttgggtttctttttttttttttt

SEQ ID NO: 9906 - DNA, 411 bp, Homo sapiens
  misc_feature 365: n = A,T,C or G
ggcacgagggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggagttaagcgggaggacgcgcgggacctgtgagccctcccggaggtggaccccctttccagcacctctgcgagagatccggagacctgtgggcagctggcggaggggagactcagcagacggaccctcgtccgtgcctgccttccanaatggagccaggcttccaactttcgctggcttacgacatagggacg

SEQ ID NO: 9907 - DNA, 229 bp, Homo sapiens
gcacgaacaggggcatcccgcgtccacgccgcggggaggatggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagatta

SEQ ID NO: 9908 - DNA, 597 bp, Homo sapiens
ggcacgaggaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatg

SEQ ID NO: 9909 - DNA, 411 bp, Homo sapiens
ggcacgaggggcgggacggtacagcacccggaggaaccttgattccctgccccgcaagcccagcaccggttttgccgccttgtctcgaagggtcaaccaggccatctcctgcctcgggacggagagcgccctggaaaaggcggaggggccgaccttagtcacacaagagcgatggcaagattttcacccaagccatctgacttggaacccatggattaaccaactgccactggaggcaaatccagagaccaagggagcagtttatacagaaacagaaaaattagccgggcatggtggtgggcgcctgtagtcccagctactcggaaggctgaggcaggagaatggtgtgaacccaggaggcggaggttgcagtcagccgagatcgcgccactgtactccggcctgggtgac

SEQ ID NO: 9910 - DNA, 596 bp, Homo sapiens
ggcacgagccaggagtcaacccagaacttgccctgaaggacttcgccacacaaccaacctctccaagacaaacggagaggaaaaaggaagctgccgaggaagagcccacagtatgtcctcacttggggaaaaagaaaactatgcatggattggtatatgtaatatacatacatacatacatatatatatatatatatgcattaagtgagtaacaaaaagtctggaaggatacgttcaaactattaactggggttacctgcagggagggtgccaagggaacttttacttttactacatatatttctggcttatttgcatttttcacccaagtatccaagtgttacttgagtagtttaacatgagaggaattattagggttgcaattaacatttgttgcatgaatagatggcaaattcatttcctaggcttgtttttttcaaattctgggtatgacccatcagtggattgcaaaattaatttcgtgggtagcaatcagtaattaaaaaaaaaacaaatacacaagaacaaaaaggattacagaccagcagacacagtaggggagttatttcagtaaacttttgtttcagctatataca

SEQ ID NO: 9911 - DNA, 279 bp, Homo sapiens
ggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagagtttaatccttacattacctgctatatctgtaaagggtatctgatcaagccaacaacagtgg

SEQ ID NO: 9912 - DNA, 516 bp, Homo sapiens
ggcacgagcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaaca

SEQ ID NO: 9913 - DNA, 506 bp, Homo sapiens
ggcacgaggaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagcc

SEQ ID NO: 9914 - DNA, 278 bp, Homo sapiens
ggcacgaggtggcccccttccatgaccaccaaaacggcgtgcacaactacgacctgcacgacaccgtctccttcgtgggctccaacaccttctacctcaacgcggcgcaaacatccggccagtcggcctgcctcggggccctcctcttcctctacacgggagacttcttcctccacattcggttccacgaggacagcaccagcaaggagctgccaccctcttggctgtgcctgcccagtgtgcacgtgagagccctggaggcgcaggcctgagcccgc

SEQ ID NO: 9915 - DNA, 342 bp, Homo sapiens
ggcacgaggttctgagcaactggaggctgctggggctgtggtggcggctggtggtgctgtgtgtgatgcatctgctgcagctgctggggcagagcctgggagggcggaggctgtggctgctgcatcggtggctgctgaattggtggctgggcctgcaaagcctgctgctgctgctgctgctgctgctgctgctgctgttgctgttgttggagctgcagctgtgctattcgctgcagctgctgttgctgctgctgtatctgttgctgattttgatgatgcaatttaattagatgctgctgctgctgctgctgctgctggaactgctgctgctgctgcactact

SEQ ID NO: 9916 - DNA, 210 bp, Homo sapiens
ggcacgagccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccactgaggcggctcccagctgcgttggcgacatggccgaca

SEQ ID NO: 9917 - DNA, 99 bp, Homo sapiens
ggcacgaggagagagagagagagagagagagagagagagagagagagagagagagagagagagagatctttttttctctctctctctctctctctgtgt

SEQ ID NO: 9918 - DNA, 533 bp, Homo sapiens
ggcacgagcccgcgctcgccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatc

SEQ ID NO: 9919 - DNA, 373 bp, Homo sapiens
ggcaccagagccaccacacctggctaggtttacatttttagaatatcccttggaaagtggttggagagtagcaaaagtgtgttgtttggtaaaatatctctggaaggaaacttcagacaatagtaacagcagtcttcttggcaggcaacctgggagacagggataaatgggagactccctgtttataacatacccctttgtactttctaagttttatactatgtacatgtattcattgactgaataaatagctttataaagtcgtttttataaaagagaaggttgggaggagctatcaggtagcaactgcagatgtctaaggaagaggtcatggtggtcatttggactgggtgctggtggtggagtcaaagtg

SEQ ID NO: 9920 - DNA, 509 bp, Homo sapiens
ggcacgaggtaaagacaaggctcattaattcagatatttggaattcaaaaatatttaaagttaaccacagcataatgaatcctcaacgtccagagttctacaaaaatccagcaaaacttacttttactcattcatcagttctatgtcactccttagtttccctaaaaaaatatggctttataaaaagtagcttctataattcacaaaatgaagagttttattataatttgagtatcatctctgtatcaccgacagcacagctttagaaaattattgcttttcttattatcttattatttcaggtttcattacacatcgagtacccatgcaggactcactacattgtataataactatgatctatagtgataaaaatatagaagtatctttgattttaatcctaaaagcagggggaaaaagtcaccttatcttaatgttaacaaaatcaagagctacccctaatatatcgatcaaaccacttcttatggctttgcttatagttgctcatg

SEQ ID NO: 9921 - DNA, 608 bp, Homo sapiens
ggcacgagattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttatattcactggagagcataatcccacacgggttgtttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgttttttc

SEQ ID NO: 9922 - DNA, 650 bp, Homo sapiens
ggcaccagccggggtcgccgcagcccgggaggagtgtctggtctccggcctgcctgtgctgtccccgcgccctgtccactggactcccgagacccttggaacccaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgca

SEQ ID NO: 9923 - DNA, 502 bp, Homo sapiens
ggcacgagggaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacgaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaag

SEQ ID NO: 9924 - DNA, 312 bp, Homo sapiens
ggcacaaggtggaatgggaggaggtcgcgctgtccatgggcgtccttggcctgcgccacccacagatgataaatagccaaagacgtcaatggcacccatggacatagtaagcatagtaggagctgaaaaactagaagcaatgacaatgtcaactattatgagcacaaagaagcagtgtcttcggaacatttgatcgtataaccagaaattaaaggatgagaaaaacatttttctgaagcttatactttcacatttcctagagagcatatttgtgaggatgggggtgggtaaacactcaacaaaggtttcttt

SEQ ID NO: 9925 - DNA, 514 bp, Homo sapiens
caccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagt

SEQ ID NO: 9926 - DNA, 595 bp, Homo sapiens
aaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatct

SEQ ID NO: 9927 - DNA, 532 bp, Homo sapiens
tattaacctgttgtcatatttgctacaaacatttccatgatgaattatttgtcttttaatattgttcattgtttggacatgtagaaatgtgttatcttaggagtcaaaatctgtccaacttttgttttgtttttcctattctatacttggaagaacttattctccaagaagtttgataaataagtacattatatttaatgtttttaaaaaatggtttaataaactatttcccctgcaattgctatttagccatcttgtcattatttattaaccaattcttcctttccacagtgatgtagtatcttttcagttatattagttatagagtcagatatagctcttgttcagtgccatactgttttttttattgtagctttataatttagtttagtattctcactaggccagttttttaaagagacggagtctcactctgtcactcaggctagagtacagtggcgtgatcttggctcactggagcctctgacccctgggttcaagtgattctcctgcctcaacctccctagtagct

SEQ ID NO: 9928 - DNA, 543 bp, Homo sapiens
ggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatatcttgtaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaat

SEQ ID NO: 9929 - DNA, 356 bp, Homo sapiens
aagttttattttaaattaaatatagaaattattggcaacaacactggataggatttaaaacaaaaataaaaattgtttaccaaagtcaaatgatttgaaaacatttttaaaagcttatgtgcctgttaagatgaaggccttgcgctagttgctcatgaatcaatagctaatatgacgtaggagagtaaaaggaggcagatagctaaataagtggtatggtggtgggcgcctgtagtcccagctactcaggaggctaaggcaggagaatggcgtgaacccgggaggcggagcttgcagtgagccgagatcacgtcactgcactccagcctgggccacagtgtgagatctgtctcaaa

SEQ ID NO: 9930 - DNA, 429 bp, Homo sapiens
  misc_feature 327: n = A,T,C or G
ggcacgagctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtgggcacttttcgtccctttcacggngtaatcaagaaaggtggcttcgtccctgtcatcgcccactaagggaagccaatgaggaggttgcacttcgtgtaccacaacttgtggcccaagaattggccc

SEQ ID NO: 9931 - DNA, 402 bp, Homo sapiens
cgttgctgtcggtgggagagaagtattcacattctcaggctccaggcctgtgcaaccagaggagtggaattgtcattgaagggaggcgggaggaggggtgatggtgttagaagagataatatgcatgtggccacccccacaaacctttaggaatgcagtgcataattaggactaaaggcactgatttggatgtggtgggtgataggtggtctgtgggagtaaatgagatgaatgagacactagaagtaggttggaaatagaatcctggggacaagaatcagtggagaaagaggtgactgtgaaggaatcaggatgcaagaagagtcagtaaagtttagccttcaagaagtcaacagaagggggagaatttgaattctgttttcaacctgttttggttggagg

SEQ ID NO: 9932 - DNA, 540 bp, Homo sapiens
gaaatggtaagagtgattagtgaaatgtaattactgtaattttttccccattcaactttatatatctttaactgatgaccagatcattgttgttctgaaccagtttgtggtcagcaagtgttttgtggggttttgtttgtttgtttttaaagaacagtttgggtcacttgacatggttctccaaagggatgttatgggttgtatttggttctgggtgataaccgacttgttagataatttagataagcaaccgagttgccatgtttgtttgtcgaatctcaagtgtagcttatattttatgttcctagagaggttgtcagggaagatttgaccctttggcaaatctgtttgaatagagatactagccatgctgcccaatagggctttctggccctgaaaaagatacggagtattcttggaaagttgaagggaaaaagaataaactgatccatgtagtagcatgcagattattgaggaattttctaaaggtatctctctcggtgtatttctctacttacctgtaataatgcttttgtctta

SEQ ID NO: 9933 - DNA, 593 bp, Homo sapiens
cggcacgagcaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaat

SEQ ID NO: 9934 - DNA, 550 bp, Homo sapiens
taaaacaagatctgctgttcatattttttaatttctcaggaagggtacattttgggctttgggtttatactgcgagcctttttttgtttttcttgtatgtatacctaagtagtcatatgttttcacatggtcagagttttgataataatactctacctagcttctgaacagtttaataatagatttaatccgtgagaggaaataccctcgaaagttactatataaataacaccttactatctggtggcatttacttagttcttagaactggctaattagtttatcggttaaagtaatttgctattatattgtaaaatagtacatttgaggctcacttataaaaattggaaaacatcgaaatataagaggtccaagagggtgtttgaaacacattttgctaagttgacaggaaattaatagactttttatgggccattaactaataatacactcaaaaaaaaggtacagttaaataaaggttttaaatagtctataccgtatactaaaactaaattaatatttaggactgaaataacatattgattaagta

SEQ ID NO: 9935 - DNA, 524 bp, Homo sapiens
ggcacgagcccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaagacagagtcataattcaccaagtagtgaatttgagtggagtcaagtaaagcccagtttgaagtcaactaaagcaagtaaaggggggaaatcagaaaattctgccaagtctggatc

SEQ ID NO: 9936 - DNA, 422 bp, Homo sapiens
ggcacgaggagagagagagagagagagagttagagatagagagagagagagagagagagagagagagagagagagagagagagagagagagagagagagagagagagagagagagagagagagagagagagagagagagagagagagagagtgagagtgtgagagacagagagagattgagagcgccccccccctctttctctcccctctctttgtttttttttttttcccctctctctctctctctctctctctctcttttcttttttctctctcctgaggggtggcccccttctctctcttctctctctctcgcgcgcgcgctcctttttttttgtggctttctttgttgggcccctctctcctctccctctctccctctctcacccctcctcgtgtgtgttcgctccctctctcccccc

SEQ ID NO: 9937 - DNA, 463 bp, Homo sapiens
tgctcgatctgcacgatcccaacgatgcgaaatcggcacgagcagaaacccggttcccagcgtcggcggcccggcttccgctgcccgtgagctaaggacgggccgctccctctagccagctccgaatcctgatccacgcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaaac

SEQ ID NO: 9938 - DNA, 562 bp, Homo sapiens
ggcacgaggcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttg

SEQ ID NO: 9939 - DNA, 146 bp, Homo sapiens
gccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatc

SEQ ID NO: 9940 - DNA, 398 bp, Homo sapiens
tttcaaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaa

SEQ ID NO: 9941 - DNA, 145 bp, Homo sapiens
gaaccatgcttctttctacaagtttaggaaaacatttcacgtgggagtgaacaacagattgtggtgatggttacacaactctgaatataaaacactgaactgttggctcacacctgtgatcccagcactttgggaggcgggtcac

SEQ ID NO: 9942 - DNA, 349 bp, Homo sapiens
cattggctttgcttgaatttttgcttggttggttagtggaattagaatgaataggttttaaggccatttatggtggctcatacctataatcccagcactttgggaggccaaggcgagagaatcagttgaaaccaggagctcaagaccagcctggacaacatagtgagacccccgcctctataatttttttttttttttaaattacccaaggggggtaccacacccctttaatcctacctactcaggaacctgaccaggaggattgtttgaccccaggaggtcaaggatgcagggagctatgattaccccactgctttccaccctgggggacaaaacaaaaccctgtttt

SEQ ID NO: 9943 - DNA, 393 bp, Homo sapiens
tccaggtaacaaccctgcacatatatcccagaatctaaaataaaaatggaaattataaaaaaaaaagaaattaaattgtgaagaaaacaaagtatcaaaagaccttttctgttaaagtctaacaatgttcaaatttagcttcttggaaataacttttaaatagctaaaagcgtcaacagaaaactgtggactacaggaaaagaactgcttcatatttcccgaatcttctcaaacttggtatctgcatatcaatgactttagattttatttttatgttgctgttacttttgctaaggaagtattatggtatacatagatactgtctatgctattttaaaaaatatctaggaaaatacattaagatctgtttattattactattaggggtttctt

SEQ ID NO: 9944 - DNA, 378 bp, Homo sapiens
aagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaat

SEQ ID NO: 9945 - DNA, 441 bp, Homo sapiens
ggaacctgaaatgagaaaagggtagtgaaggaagacttgatgtccttcataactggcctgcatcctgcccagcccctcctttctttccagaagcccaccagtggcccagagtggaagggtgggagtcagaccagtccaaggttgctaattaagactggactgccaggcacggtggctcatgcctgtaatcccagcactttgggaggctgaggcgggcagatcacctgaggtcagaagtttgagaccagcctggccaacatggtgaaaccccgtctttactaaaaataaaaaaattggctgggtgtggtggcacgcacctgtaatgccagctactcaggaggctgaggcaggagaattgcttgaacctgggagacggaggttgcagtgagccgagatttggccactgcactccagcctgggtgacagagtgagactccgtgt

SEQ ID NO: 9946 - DNA, 494 bp, Homo sapiens
aacccagcatttgggcatctagaagccttcccaagggctaaggagacacctgaaaaatgagaaagagttacagagccaggcccttaagttggccctgccaaccactctccaaaacccttagatttttgctgcctttgcccttgacactgtcctttccctggagctgaatgtctgggggtagaggaatgactttaaaagtcgaggatcaggcctggcatggtggctcatgcctgtaatcccagcactttgggaggtcaaggcgggtggatcacctgaggtcaggagttcgagaccaggctgaccaacatggtgagaccccgtctctactgaaaatacaaaaattagctgggcgtggtggaagccacctgtaatccaagctactctggaggctgaggcaggagaatcgcttgaacccgggaagcaggggttgtagtgagccaagatcacgccaccacactccagcctgggtgacagggccagactccgagtgttcc

SEQ ID NO: 9947 - DNA, 656 bp, Homo sapiens
taaatgggatacacgtcttcttaagtaattcaaagtctagtaggggaagcagaaaggtaacaaacaattaagatacaaaagtaaaacaaaagccctctgtagagtgctccaacatcttttattccttatcatctccccaaattccaatttgctgcccctatatgccctttaaaaaaacccaggccgggcacaacggctcacacctgtaatcccagcactttgggaggctgaggcaggaggatcacttgaggccaagagttggagaccagcctggctaacacggtgaaacttcgtctctactaaaaatacaaaaattagctgggcgtggtggtgcgcgcctgtagtcccagctactcaggaggctgaggcaggagaatcgcttgaacccaagaggcagaggttgcagtgagctgagatagcaccactgcactccagcctgggcaacaaagcaagactccatctcaaaaaaaattccggaactaggcgtggtggctcacacctgtaatcccagcactttgggaggccgaggcgggcagatcacctgaggtgtcaagagctcgagaccagtctgggcaacgcggtgaaaccccatctctactaaaaatacaaaaattagctcggcgtggtggcaagcacctataatcccagctaacttg

SEQ ID NO: 9948 - DNA, 554 bp, Homo sapiens
  misc_feature 406: n = A,T,C or G
aaatgatacctttaaaaaagcctcttcctaaagacttcttttaagtaaaatgatgatcactaattactttgttgtgagcacaaataagaattactttcttcaaaaattctaactaaataaattactccagtcaaaaagatgtactcaattaattctttattaagggcgttgtaaaatctaagtgattgttccagagaagttaggcagtgccaggaaaatatttatcacttagcttagtaattatttacttagaaaaagttcaaaaaaggccgggcgcagtggctcacacctgtaatcccagcactttgggagaccaaggtgggcggatcacgaggtcaggagttcgagaccagccaggccgacatggtgaaaccctgcgtctactaaaaatacaaaaatttagcanaaatttagctgggcatggtgggtgcctgtaatcccggctactcaagaggctgaggcaggagaattgcttgaacccaggaggtggaggttgcagtgatcttagatcacgccattgcactccagcccaggtgacagtgggagactctgac

SEQ ID NO: 9949 - DNA, 635 bp, Homo sapiens
gactttcagagacaaacaaaagctgaggaaatttatcaacaccagacatgtcttacaagaaatgataaagggagttctttaatctaaaataaatggacactagatgcaacaagaaaccgtctgaaggtattgaactcccaggtaaaagaaagaaaatagacaaacttaaaatactcctaatactgtaatcgggataagtaaatcatatatcctatgtatgaagactaaaagacaaaaatgttaaaaataactgcaggccaggtgcggtggctcacgcccagtaatcccagcactttgggaggttgaggcgggcagatcacgagatcaagagattgagaccagcctggccaacatggtgaaaccccatctctcctaaaaatacaaaaattagatgggtatggtggctcacgcctgtaatcccagctactcaggaggctgaggcaggagaatcgcttgaacccaggaggtggagtttgtagtcagccgaggtcacaccgctgcactccagcctggcgagagagtaagactcagtctcaaaaaacaacaacaacaacatcaaagactacaacaattagttaagagataggcaatataaaaagatgtcaattggaatatgaaaagtaaaaatctggggg

SEQ ID NO: 9950 - DNA, 86 bp, Homo sapiens
aaaaaaaaaaaaaaaaaaaaaaaaagggggcccttttttccgtaaacccaaacttaaaaaaaaccttggtttttttggaaaaaccc

SEQ ID NO: 9951 - DNA, 615 bp, Homo sapiens
  misc_feature 382: n = A,T,C or G
catttttaattatctcaagtgttgcattctgtagatgaagcttaagagctagatcttatttgaaaaaatctgtcatctaagtccctgtgtcccacatttattcaagtgcataaagtaataaagaagatgctagtttttaacttattgtttgccttttcattttttaatagaaaaccaaggcaaaaaaaagtgtatattatgcacagtgcttggcacaaagtaggatttgagatgtactttgtctcattttatcaaaatatacttatataaaggtgaattaggtagctgcctagatggtgtaattttaagtgcaccaaaagtctctgaatgactgcatcatgggtgaccttaaggaattttttgtttttattggatatctcanactacctaattagttaggcagtaaacgtgtcattggccccagacagctgctattaagctattatcattggcatataggcataaattatatacttgaactgcatggatacagttcattaattgatgttttgagccatgataaatcagagagagagagactaggatagcaggggtaaattctgagttttaaaggaaaaagaagacagtggcaaaccagagaggacaggtctgaat

SEQ ID NO: 9952 - DNA, 71 bp, Homo sapiens
ggctttcgcatcactgatcagaggtcagcattcacctgggtccctttggagtggtgctgacttctctcctc

SEQ ID NO: 9953 - DNA, 353 bp, Homo sapiens
cacaaaaaacaaattgtgaattaaaacaaattatataagtaaatgcatatttagcataagaaaagaaatcccctcaaaataccaaattttatctaatacatactacaatacataaaaataattttttttatttattaacttcatagcatacctttctaataccacattttctttcttttttttttttttttggaaacaaagttttctaaattttttggccaaggctgcaaaacaggggggggatttaagttaattgaaacctttcctttcagggtaaaaggaattttctggcctaagcctccaaaaaagttaaaataaggggggggcacaacattgccgggttatatttgtgt

SEQ ID NO: 9954 - DNA, 82 bp, Homo sapiens
gcaccaccttcaacattggcgatcaactgtcaatatgagacttgaaggcaacaaatatccaaactatatcatttgtaatatt

SEQ ID NO: 9955 - DNA, 432 bp, Homo sapiens
aacacaagagtcaacactctgtaattggaaatattaatctgtgtgaaggaaatagctaaattaatgtcaaacaacaatcccgaagacaaagctgatgccccagactcagtttcagttgggattaaatagatattatttcagtgtttattaaaagatgagacacattaactaggttatcactcgtatttaagtttctttaactatacgggtctaatgtaggtactaaacaaagttaaaaatattttaaaatagctaaaaaataagcaaatttgcatacagaaaataaatttattagacacttttacatttaattactgaccatttgtatatcttctcttgagaaatatattttcagtttttgtccatattatctaaactatctaaagtgagttttaaattaatactcacctggaagtaaaagtaaagtgtgtt

SEQ ID NO: 9956 - DNA, 366 bp, Homo sapiens
gctcccctaacagcctttaagatgtggctacttgtttttcccaccgtttaacaccctccaacttcatttggagcacgggttcctcaagggatcctgagagctgggtgctgggtgctggtttggagaggcaggatgatgcttctcccggctggggagagcagagcaggaaggctggttggcgccatgaggaaagagccacgaggttttagctcccgaaccgactcgtcagtagcccctcctccatgttggttttacatttttccctcctggtctggactactttagcgcaaggagcccagccagacacggcagcaggccgcattgacccgtctccatcggaccccagcccctatctccaagagacag

SEQ ID NO: 9957 - DNA, 562 bp, Homo sapiens
ggcacgaggagaaagtaaagtccctttataatggcatgtgaaccagacaatttagtagccagggttgtaaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtctttcagctttttatacaatactgcctgttatcagaaagtatagtcttaaaatctgctatcaagcatctatcagaagcctgatgagaaatattcagatgatctaacgcagttcccaaacctgcattgtgggccgttttcattacaattacctaaggtgctttaaaaattttcttgggccctactcgttgtggttcagcagctgtgtaatggagcaaaaaggaatagtcactaaacagcgaaggaaagtggtggaattattgaaagacctagcacttacctg

SEQ ID NO: 9958 - DNA, 515 bp, Homo sapiens
ggcacgaggaaggaagaaaatttgggactttgttttaaaagtggaatactatcttcttaaacaacttgtgtttaaaacaagccccaatccacacttgatcttcttaagctaggaaaagtgagctcacactgagtgctggcaggatgctccatgtgcatcattattttgtttaattctcacaataactctctaaatcccttttgaggataaggagactggggctgggagaagttatttcaaggagtaaataaaaaattcagacccacttgggttttatgccaaaggctctgtttttacaaatacacaatattgttgcccagttgtgatgaaacataatttatgaatttcactgagggaatttcgcaaaaggaaagaatttacttttccctctaaagcagaggcttttcatatgcaactgttaaaagacacacgagcttgtgggtctgatgggtggtctgagctgttgctgttgggagagctgctgggacactagcaggaagacgtagtttgtgctc

SEQ ID NO: 9959 - DNA, 498 bp, Homo sapiens
tggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagc

SEQ ID NO: 9960 - DNA, 386 bp, Homo sapiens
ggcaccagtttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgatttttggggacgtaattacttcataggtattatgcatttttggatagaggagtaaagtagtgaaagtaatgtttttaggatggtttgtctggcagcagtgtgcaaaatgaattggt

SEQ ID NO: 9961 - DNA, 612 bp, Homo sapiens
cgaattcggcacgaggctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctaccacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccaggctgcctcctggtggt

SEQ ID NO: 9962 - DNA, 643 bp, Homo sapiens
cgcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacct

SEQ ID NO: 9963 - DNA, 91 bp, Homo sapiens
gaatgggtgattggagattattagattctaggttaacttctaccactttaccctaatacataaaactttttcctaaataaatgatggaagg

SEQ ID NO: 9964 - DNA, 105 bp, Homo sapiens
gtgcatctcctattcaaggcactggggatgaagcagtgaacaaaatagaaaataaaaatcctggccgggcgcggtggctcacgcctgtaatctcagcactttggg

SEQ ID NO: 9965 - DNA, 532 bp, Homo sapiens
gactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatgg

SEQ ID NO: 9966 - DNA, 86 bp, Homo sapiens
gctgagaatggtgtggaggagaaaaagaaagcctgcaggtcgccaacagcccaatcccctaccccatctgtggaggcggactcccc

SEQ ID NO: 9967 - DNA, 68 bp, Homo sapiens
tgtgtgcgaagaatgggtgtctggaagcattgtgcattgagacgactgcaggtaactgcctggtatgt

SEQ ID NO: 9968 - DNA, 416 bp, Homo sapiens
ggcacgagacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctc

SEQ ID NO: 9969 - DNA, 337 bp, Homo sapiens
ctactccaggaaaaaaacatcctttatgtaatgagcatttattcactgaacacctactgtatgtgctcaattctgcgctggacttgatacacacacatatacacacacacaaatactcacaagtatatgcgtacaagtacacacacaagtacacaaatatgggtacacaaatacacaaatatacacatacaaatgcgcacacacaaatacacgcacgcacaaatatatgcacacataagtacacaaatatacacacataaatatacacatatatgcacatatatgtaaacacatgtgtatataggacatgtgtaatgtcataaaattctcaccgtag

SEQ ID NO: 9970 - DNA, 92 bp, Homo sapiens
tatgtacacaattagctgggattacaggcgctcagctgccatgtccagctaatttttgtatttttagtaaaaacagggtgttggccaggctc

SEQ ID NO: 9971 - DNA, 409 bp, Homo sapiens
ggaggctgcagtgagccaagacggcaccactgcactccagcctggtgagactccatctcaaaaaaacaaaacaaaaacaaaaaaattcctgggttcaagtgatcctcccacttgagcctccagagtagttgagaatacaagcatatgccactgtaccctaatttttttattttttcttagagacagggtctcgctatgttgcccaggctggtgtcgaactcctgggctcaaacaatcctcttgctttggcctcccaaagcactgggattacaggtgtgagccactgcacctggcctacaccaacctacctcctcctcctcctgcctccatcaagatttctccctgctcccaacttttgcccaagctgtagctcctgcccagaatgcctgtgcttatgaactcctacaca

SEQ ID NO: 9972 - DNA, 169 bp, Homo sapiens
tatctacgggatcataagtctaggtgtctataattcagaaaactacctttcattgtgtatttgatgtttttgtatatccagagcgtattaataaattgaattttaaaagtctcttaaattaaaggagctaggttgggcgcagtggctcacccttgcaattctagcactt

SEQ ID NO: 9973 - DNA, 87 bp, Homo sapiens
tacaaactcatgtttatgcaatgagatttattagactgatagttcatatcttagccccttttcatagagaatcattgaaaaaaaact

SEQ ID NO: 9974 - DNA, 221 bp, Homo sapiens
atgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagagggttctgaggggaggaag

SEQ ID NO: 9975 - DNA, 540 bp, Homo sapiens
atttattatattttaacttgtgaaaggggttaaagtgatattgtcaaatttcatattattccatttttaaattttattaataaactttgatatgacttcacatttttataatacatttaacaaacagggtgaaaaaagagatagtatcttgatagtgctttattatttttctttaatcatatagactatattttcaaactttgtattttaatatttactatttaataaatgctatagttttcaaacatcttcttccattctattttttttaaactaacatttcttatttgcccactttagtagttttcatctagttacgtttactaaaaatacaaacattaataacttgttaggatttgagatgaagcagtataactatgatacaaagagtcaatgtttattttctccctcaaatgtcttcttggcagttgtattctttattaggatatataggatattaagaaacaacttgtggccccgcacagtggctcacacctgtaatcttagcactttgggaggcccaggcaggtggatcatctg

SEQ ID NO: 9976 - DNA, 404 bp, Homo sapiens
tttctagcaatattcgcatgtcatggaggggaagtgactacccccagaaataatacaactgcttacccactccatgaagtgaaagatttgaaagacatttctctgttccaaaggcctgtgggcagaattaaaagtaattgccagaaaagccagtttcaaaacagtctctacacttgcatttattgaatgagcttattggatatcttggttgcaagcaggaagcaacctgctgacctgagctccctgtggccctggtcctctccactctgaaaacatccaggcagatcttacaactcctccagtcacacccagataccaactctaggccagaccaatgcaatctcttgcctgtatttcaacttttgatttctattgtatttatttaatgttccctccttcccccc

SEQ ID NO: 9977 - DNA, 252 bp, Homo sapiens
agtgtagtggcatgacctctgcctcccgggttcaagtgatcctcgtgcctcagccacctgaatagctgggattacaggcgtgtgccagctaatttttgtatttttagtagagacagggttttgccatgattgccaggcttgtcttgaacttctgacctcaagtgatccacctgcctcagcctcctaaagtgcactatttatggtgaggggttggttttgaaaatgtccagtaagtcatgaacagatgctttt

SEQ ID NO: 9978 - DNA, 418 bp, Homo sapiens
atcgtatgaactacaactattaaaatgtgaaatgcatgatgcaaatagtgcacaaaaaaatagagtgaaaatgatgaatacagccataaaagacagccaaactccattttagcaataaagtaaaatataatctgctgtcaggggaaggtaatttgaagtacttgagatgttctttaatttaaaaatccaaaaatatttttagctttagttactataaaacatgtttaagcattttccatttgaaataaaattttaatttcatgctttgtcagtttccctaaataaatagaaaatagtaaaatatcgcatactaaaaaaatcaacttctttggtaataaatcagttcaactgtcagaccaaaacatagttacattttacccaatgtcatgctgaccaatttgatcaaatgccacttcct

SEQ ID NO: 9979 - DNA, 159 bp, Homo sapiens
ctttgtatggtagcttcatgttgaagtggttttttgtttttgtttttgttggtttaatttgtaaaatctggaaagttagcttgttctaataggggctatgctctgcaattcccttttttttttttttttccctccccctaagcaaaacctttaaaaaaa

SEQ ID NO: 9980 - DNA, 294 bp, Homo sapiens
tggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcaca

SEQ ID NO: 9981 - DNA, 392 bp, Homo sapiens
  misc_feature 392: n = A,T,C or G
ggcacgaggcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccan

SEQ ID NO: 9982 - DNA, 174 bp, Homo sapiens
gcccagcagtgcgggaggccaggaaagtaggcttggggaggctggcctctcctccagtttgaagcatggcaggggttccgggggaggctgctggggggcctgcgagcatgtccagagcaggaatgcttggggtggtgtgtgctttgctcgtctgggcttatctggccgtgggga

SEQ ID NO: 9983 - DNA, 289 bp, Homo sapiens
caccatgaatgacgggctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctc

SEQ ID NO: 9984 - DNA, 399 bp, Homo sapiens
ggcacgagaaatggccttaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcgcctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaag

SEQ ID NO: 9985 - DNA, 242 bp, Homo sapiens
ttggcaggagccaaagatgttgccaaacatgtagtacacagaacagctcccccagacaggattatctggtcccaaatttcaatagtgccaaggtggagaaaccctggagtagaggatgcctggtatgaggcaatatttgggatagggaagggaagcttgggattttagctacgtagagacacttgaaaattggagggaggaaaggagtgggtggctttggaaatgttctggaatatgtgaat

SEQ ID NO: 9986 - DNA, 466 bp, Homo sapiens
aaggagaaatccggttgttgcaatcttacgtggatgctgatgtatcctttcctgggtttttaatatctttagtcaaaggaatttattttcaataagtgcaccaaaacttttataaattaatcatttccctaaagttattgttctttcttaaccgatttcttcactatcacccaagagaatcctgtatctagttttcctgacccttagaaatccattgtggtatgtgtcaactcagctaggcaaaaagaaaaagcaaagaatccattgtgggatggatgtgctggttaggtgcagatgcctatagagataggagcattagaaatctagtaatagaaaatattagcaaagactgattaaaacctcctttttctttgacgttgcctaaaatatatcatttcattgtagttataatgatgaacttggcttgtgactggtagtcattctaagtatttgatcaacgaagcct

SEQ ID NO: 9987 - DNA, 282 bp, Homo sapiens
agatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatc

SEQ ID NO: 9988 - DNA, 294 bp, Homo sapiens
aacacccggaagagtgcctggcacatggtaggctctcaataaatgtttactggacaagctaattcatgcaatcaatccttccttcacttgccatgtatttctggagagtctacccagtgtcatgccctgtgccaggtgcctggattccagctgtgatgaaaatgcaggcctggtctaaggatgaaaagtcataattaaagaatagggagagggggacgtgatagtttcagaaacaggatcttactacattttacaaaaacctcaggaggcaggtattgttcttattttacagat

SEQ ID NO: 9989 - DNA, 533 bp, Homo sapiens
taatgcaaaaagccaccttttgatcagaaagcactgggcacggcctttcaagtttttctacacttctttccacattagccaaatgagcccgtgctctaaagatctgtagttaatgccgattctattttccatttttattctatgttttatttgtccatagcatctaggaaaacactcatttttttcccccatagtcctcaatgtcaatcttaatttttctggcttagtccctccaaagaatgaaattgttccttggacaagtaaaagaaaattctagaaaataaaattgtcaaagaagaattataattttctaaaatagaaaaagagaaactacattgtgagctttttttccacagatgttataaattttgttgggaggaaatgcataattattagaatcttaacaaatatcaccctattcgttctgcagcaaagaacagagctccatgggaggaaataatttggattatctacagtaaggttgggagatctaggaagaaggacctaggaagaggccaccactcccagcctct

SEQ ID NO: 9990 - DNA, 534 bp, Homo sapiens
caccaaacaaaaatcctgctaccagagggcttagtgatagtccatgagataagcctcctgagacttccacacccttagcctcacagggttggcccttatatccaaaacaccattataacaaacagcatatgagaaagccactgcacagaagctacctgcaaccaaggaacccatacagagccttgacccactgaaaatgcatagaaattaagccaaaaaaccatacacaacataaaacacatttatacactcaagaaaaaaagaatttttaaaaataatccaaacaatatcaaatttaaaaaaagaagtaacagctctctgagatgaaaaggaatcagcaaaagaacgctggcagtacaaaaaggcagagtgttgtgacaccaccaaaggatcacactagctctgtagcaataacagatcctaacccaattgaaatatctgaagtgatagataaagaattcaaatatgaatggcaaagaaactcaattagatccaagagaaagttggaatctaacacaaagaaagcaggaaaac

SEQ ID NO: 9991 - DNA, 609 bp, Homo sapiens
tctacatatgtatttttaaatgaaaatataaatgtaaattgatacatttgttttatatgactaaaataggacacatttcttagatattattcttactgacatttcaaggcaaaaagtagtttagaatgtcttaaaaaaaagaatgtcttataattaatttggaatataaataagtataaagatttaaactgtaaaagtcccatcaattgaagtcaagtaatgttaccgctataattgggaatacaggcaaaagagaaaagaaagaagaaacgaagggaaagagattaacagagaaaagagggaaagataaatgcagaatgaagacagagaaaggaaaggaggaaggaagggagagaaagaaacaagatcagccgggcacggtggctcacgcctgtaatcctagcactttgggaggccaaggcaggcggatcatgaggtcaggcgttcgagaccagcctggccaacatagtgaaaccccatctctactaaaaatacaaaaaattagcttgggcgtgttggcgggcgcctgtaatcccagccactcaggaggctgaggcaggagaattgcttgaacctgggaggtggaagttgcagtgagccgagatcgag

SEQ ID NO: 9992 - DNA, 400 bp, Homo sapiens
gttgctctatgaaaaacacacattatcatttttcacaacattaggaaccaaacacagtatcataaaaacatagaaaaaaaggaactaattttatcttctactcacagatgatgttcataatcaaaatgacatgtgactaatagtcagatatcaaattactggagctctgctcttaaccacatattactccatatctgtttctttatggcagcaaaagacaagactccagcagtggttcagctgtataatgggaatatgaatattccaaaactttctgtatgccaggtgattgggaacaacagtctcttaatattacctggcttttaaaagtattggcatacatttgaactaaagatttttttaaaaaataaaatctgtccaggtgcagtggctcacgcct

SEQ ID NO: 9993 - DNA, 658 bp, Homo sapiens
attttatatcgtaagtgtgattttaaataattacttcaaatgtctacctacatttacatgtatttatttgtttatttaggtaggggtgtgtgagtagctacagttagcttcaagatttaggaaatatatattttttttatgtgtgatacaaagattttaacagtacaaatggtgtttcccttggaggcatccttggtgatgaatgtgttaatattttcaatatgggttttggctgatgacaattctgtcacatctgaaataatttggattgactacatagcattatctaaatttttgtcatgtaaatatcgacattggcagcataacgtgaaaaatacatggatttctatttatacctctgacattaatcccccaaatgatattttgatgttgattaaaaatttttattcatacattttaaatgcctgatttaaatatcaatttttcaatctatcaaccaacatttctgtaaattatgaatcggatttttacattattattcatgtcatcatggcactgagttataattcatgcaactgatttaaaagtcagtgctttatactttgaatataatgagctataaatattgtagtaggacattttccaaaggcatttaaaaaaatcatgtttataagtttgtagtctgacaccacagagt

SEQ ID NO: 9994 - DNA, 643 bp, Homo sapiens
atgtaagtggaccagtgcagttcaaatccatgttgtgtttgtcagctctgggacagttttacttttgtgtaatgacagttcaatgggttggcaaagttatcttttaccaatctaaaatttcatcaaaattatatcttctttaaaaaataaaaatactgtctgggcatggtggctcatgcctgtaatcccagcactttgggaggctgaggtgggtggatcacctgaggtcaggagtttgagaccagcctgggcaacatggtgaaaccccatctctactaaaaatacaaaaattagccaggcatggcagtgggcacctgtaatcccagctacttgggaggctgaggcaggagaagtgcttgaacctgggagacggaggttgcagtgagccaagatcgcacaactgcagtccggcctgggtgacaagagcgagatgccatctcaaaaaataaataaataaataaataaataaataaatacatacatacataaaatacttgtgtaatttgaaaaaaaggattgcagggtcttcaaaatagctttttcattatattatatttaccagtaacttcagaaatatttatatgtttagtgctttttaacctccaacgccttttttgataaacttcctacttcaatttcatag

SEQ ID NO: 9995 - DNA, 592 bp, Homo sapiens
ttaacatgctactctgatattttcatttagggtcctagtttaatatatgaaaacataaacagtaaattagcagtctaggtttctgccattttttgttggaaacctattagcaacctttatctaaaaatgggaggagagctttcacaaaatagctgaatttcaccaatccctaaatcagaggaatttacagcatctcttggatgtttcttctggattgtcacagactcatatacacacacacaaagctgcttcattcattcaacatacttgtgttaattgatcttggggagacaatattgaataagacaaagtcactaccttctttgcttaaggacattgccaagtaagcagataattaccatacagtaggacaatattacaattagggcataaatggagagcttaggtcagattgttaatgaaagctttattttagaatgaaatcaaacatcagtccaaatatcctaaatgagttaatattgaaagacaaaaatttgttacttttagaagcaacaaattcctacagaagagcaaacctaatactaagccatctgttatttgcaatacacttaataaagtcaacagacggatg

SEQ ID NO: 9996 - DNA, 513 bp, Homo sapiens
aggaggtttgtgtaattatgattactgaaggaagaagacaattatgtcagagtatagaagtatataaaatagctaccaggaagttattttagagaaatttttcttaaaagactgtaatcagaaacaaagacaattaatgcagggacattccatgaacttattcacaaaagctggtaacaggacttaataatctttgaaagctgcatttccaaacattgacctaaccattaggaccaagatggacctaatattctaattaccaagaagagagtggtgatgaattaagtggggagagaaactgagtgtaaactggaagattttaatgttttatttaacttaactaattctggtagaattttttactttgaaactctattttatggtaatttaacaataaggattctaaatggtggctcagcattcagggctgagaaagacactgaagggtaatgccacaaggagaggctggataaagctctaataaaattatttcttttatgctacttactagca

SEQ ID NO: 9997 - DNA, 388 bp, Homo sapiens
ctaagctccaatgtgatgatatttggagatgggatctttgggaattaattaaggttagatgaggtcatgaggatgaggcccttatgatgggattagtgcccttataagaaaacacaccaaagtgcctgcttgctctctctctgccatgtgaagacacagtatgaaggcagcttattgcaagcctaagagagaacccttgccagaattggacttccggtctccagaaccatgaaaacataaacttctgttgtttaagccacccagtctacggaattttgttctagaagcccaagctgactaatatggttggagtccagtgctttgcgtgaagaaggtacatctctaaaactaaacattttgctcattgaagcttgatctgaaataatta

SEQ ID NO: 9998 - DNA, 368 bp, Homo sapiens
gccatctcaaaaaatataaataaataaaaataaaaataaaaataaaataaactgcttcaaaagaagctgagcatagtggtggacacctgtaatcccaggctgaggtgggtggattgcttgagctcaggagttcaaaaccagcctgggcaacatggcaaaaccctgtctctattaaaaaataaataataaagtgctgaaagaaaacaaaatattatcaacaaagaattctatatccagcaaaactgcccttcaaaaatggagtaataaaacattcccaggcgaacaaaagttaggggagctcgttacctgtagacctgccctgtgagaaatgctaaagggcagccttcaagttgaaacaaaatgacact

SEQ ID NO: 9999 - DNA, 572 bp, Homo sapiens
agagttgggaggaggaagtggccatgctgcaggtgccctaacagatccagggaagcatggagagcacagccactagcctgcctcgggctgcagggggcggggagcacatgcggcgtgcagacctttccttaggtttgtgctgggtgctctgctctcaggcccacagaattctgcactgtgagcagcgcaggtcggaagaggcatttggaaatgacacgctctgtccaggaactgcagtaaacgttctagcttgtaataatctttccttctggcagatggtgggttcacactgagttaagtagcttcacgactgctagtggctggaagcttccagattagtagtttaagccagaaaacaatgttgatacgtcttgagatgtgtataaatcatttgatttggctgggcagggtggctcacacctgtaatcccagcattttgggaggctgaggtgggcagattatttgaagtcatagttcgagaccagcctggccaacatggtgaaaccccatctctactaaaaatagaaaaattagccgggcatgatggcgcacgcctgtaattccggctactc

SEQ ID NO: 10000 - DNA, 302 bp, Homo sapiens
ttgcatcatagttggaggtcttaaatttaagtctttaatccattttgatttggcttttgtgtatagtgatagatagaggtctagtgtcattcttctgcatttagttatttagttttccaagcaccatttatggaagaaactgtcctttccccagtgtatattcttggaacctttgtcaaagatgagttggctgtgattgtgtggatttatatctgggttcacagacaacaagatctgttttttgttttgttttttttgtttgtttgttttatgagacagggtcttgctctgtcacccaggct

SEQ ID NO: 10001 - DNA, 500 bp, Homo sapiens
  misc_feature 281, 290: n = A,T,C or G
gaatgtgaggcttggtcccttgatcttgataaaaagttatagcagcagataccaaatggcggggtcctgacatgtcatgtaatttccttatcagcctgcttgtcgttctgtccaggtatgtccgtctgtccatctatttttgcaagtcggtcctctggtcatccatctctgttccttcatggttgttctttatccctgggtctcagagaccatcctgcttccatccttagtccttcatatccctaaaaatctatctgaaaagcctgtagtggaacacattntcaaagaanaatattttatttttgcatctcttaaatattttctaggccgggtgcagtagctcacgcctgtaatcccggcgctttgggaggccaaggcaggaggatcacctgaggtcaggagttcaagaccaaccatggccaacatggtgaaatcccgtctctactaaaaatacaaaattagccaggcatggtggtgcacgcctattgtcccagctactc

SEQ ID NO: 10002 - DNA, 490 bp, Homo sapiens
ctcttcaaccattcgtgctgagccctgataatgacaagtgggcactcccttgctctaaggtcaccaaagaccccagaggtggctaaagcttgacctaaggagggaggaaaagcttggacacatggaacatttcatagagaaggggaagtcaatgtgaagttgcaggtgggagtgcccatttgcagatcctacacatcgtatttcacaggtgcatactggggaaatctactacgtatttctacacttggtcaggtttggtttatgctaatattgaaaaatgtggccaggcatcatggctcacgcctgtatcgggagattgagaccatcctggctaacatggtgaaaccccgtctctactaaaaatacaaaataaataaataaataaaaacttagccgggcatggtggcacatgcctgtagtcccagctacttgggaagctgaggcgggagaatcgcttgagcccgggaggcggaagttgcagtgagccgag

SEQ ID NO: 10003 - DNA, 353 bp, Homo sapiens
ccgggtacaagctattctcctgtctcagcctcctgagtagctgggattacaggtgcccaccaccatgcctggctcatttttgtgtttttagtaagggcagggtttcaccatgttggccaggctgctctcgaactccagacctcaggtggatgcacccgcctcggcctcccaaagtgctgggactacaggcgtgtgccaccgcgcccagcgaattcttcattttataatctgtctcttccactgtgagggttgaaaggaacactgaatataacaggtgagttaattaaggggttaatgccaggaagagtcacgaaagttcaaagattctttaaaaaaacttgtctttttagggc

SEQ ID NO: 10004 - DNA, 518 bp, Homo sapiens
gagcagagtcatcctaagtgaacacatggaaggccctgaaaaattaaacttgggcacaaagttctctgcacattctcactggagaggcaggaacatttagccaaagtcaaagaccagggcaggggtaagaggaggcacccatcctagcctcaaatctctgccctgctactcaccagacacatgatcttagacatagaaatattgacaaattagctaactgtgccctggttttcccatctgcaaaatgggtataatcatattacttacctcaaagtgttcttggaaagatttcatgataatagcactcactatgtgcattagttgagcacttattaggtgccaggtggtattttaagtattttttaaaaatatatcaattcatttcatacatgaaaatcattttatgcagggtatataacaagtgcttggtagatgttagttatcttcaagatacctgtcattattagtgaaaagaaaaggtaggccgggcgcagtggctcatgcctgtaaccccaaca

SEQ ID NO: 10005 - DNA, 615 bp, Homo sapiens
attttcccaattatataactataaaacaattctggaacttgataaatgggagtggcctctcaatggccacttatagacttgttaagtatcacatatacaaccaaaagaatatcaagaggcacaaggcctctttatgttagccccaaaatgataaattcatcctaacgtgggtaaggaagaagcttcacttaaccatatgaacagagaaaaagcaatcaaaagaaacagaatgggccaggcgcggtggctcacgcatgtaatcccagcactttgggaggccgaggcgggtggatcacgaggtcaggagattgagaccatcctggctaacacagtgaaaccccgtctctactaaaaatacaaaaaattagcccaggcatagtggtgggcacctgtagtcccagctacccgggaggctgaggcaggagaatggcgtgaacccgggaggcggagcttgcagtgacgcgagatcgtgccactgcactccagcctgggcgacagagtgaagactcagtctccaaaacaaaacaaaaaaagcctaaaactttccattctctttgcagtgaccctaacactccttaagcttctttctgatagtcagccccaacttgggctact

SEQ ID NO: 10006 - DNA, 569 bp, Homo sapiens
agggtctttccagtggccccagtggtcttcgttcctggctgatcctacaagccaatatcccccaccaatgtatccctcccagccttctcctcaccccacgggagggaagaagcatggccccctctgagaagctgatgcaagttatgagcaatttctgcaggaaaatacaacgtcagaaagttcacagaccccctggaggccattcccggcctccctggggtccaagggaaaaggaggactgatccagacagagggagcctaaatcacccagatctggatccctagctgggccctgaaccagagcgggagaggctacaaagaatgtcaaggagaaacgcaggcaacagtgtagcatcaaggttggtgcagtgggtgagagtgtagcatcaaggttggtgcggtgggtgagagtgtagcatcaaggttggtgcggtgggtgagagtgtagcatcaaggttggtgcggtgggtgagagtgtagcatcaaggttggtgcggtgggtgagagtgtagcatcaaggttggtgcggtgggtgagagtgtagcatcaaggtcaacacagggggtagc

SEQ ID NO: 10007 - DNA, 644 bp, Homo sapiens
gcactaagacattcatgagggatctgctttcatgatccaagcacctcccacaggccccacctccaacactgggaatcaaacttcaacatgagatttggaggggacaaacacccaagctatatcaaccagatacaagaaattttgcctgtggtttccctttgtagcaatgtattctttctaccctctcagtcagctattgtatcattcagaatatccctagttaataagaacttaaatttaccatttataatagaaagtgtaaaagaggaatgttttataatatttattatatttttcaatcttcattgtagtcgttaaaatacaaaagacgtttcggccaggcacagtggctcactcctgtaaccccagcattttggtaggccaaggcaggcggatcatgaggtcaggagatcaagaccatcctggctaacacggtgaaaccccgtctctactaaaaatataaaaaaaattagccgggcgtggtggcgggtgcctgtagtcccagctactcaggaggctgaggcaggagaatggcgtgaacccaggaggcagagcttgcagtgagctgagatcgcgccactggactccagccagggtgacagagcgagactctgtcccaaaaaaaaaaaaaaaaaaaaaaaaaa

SEQ ID NO: 10008 - DNA, 523 bp, Homo sapiens
agcaaaggcgatcttaggctgcagcaagaggagtgaatcttgcactgctcaggccaactgtatctggagctctgccttcagttctgggaaacatttgaggaggaacatggagaaactggaacacatttggagcatttcaaccaggagggtgaagagattaaaaagtattcaaatgaaggacagctaaagatgccaagtctccttcccttggagaagggaagcctcagagatacataaatgctgggtttcaacattttggagaattgtcttatggatgaggacccaagtgccaaggcagaaatggtacagagaaccagggctcagttcagtgttcccatacccttcaaacatgtgtctggttaggggaagggctgccccggatgaagttagctccctaaccccacccctaaagttagaaatgtgaaagcagtcgatgggtaacctttggccagggatagggtggagggaatgggtggccatcacagcaatgatggacacacctgagatggaatgcagaaagagt

SEQ ID NO: 10009 - DNA, 75 bp, Homo sapiens
aaataaaaataaaaataaaaactgaaaagagacatcagcagctgcatactgtagagacttcacagatttagtcca

SEQ ID NO: 10010 - DNA, 516 bp, Homo sapiens
ctggccttgagctcctaggctcaagcgatcttcccaccttggcctcccaaagtgctgaatttacaggtgtgagccacagtgcccagcccattgttttctaatatgattttatccacttaattatatgtgtgaacttctttccctcctgttacatgatagctacttcatcatcgcatgtggttgcctggttttgttggttccactgtgtgtgggcaaataccatatcatgcagggcctccttgtagataactgtagattattttcttgggttctttattagaaatagaatggctgggccaggggcgatggctcacgcctgtaatcccagccctttgggaggccgaggcgggaagatcacgaggtcaggagatcgagaccatccgggctaacatggtgaaaccccgtctctactaaaaatacaaaaaattagccaggcgtggtggcgggcgcctgtagtcccagctactcggaaggctgaggcaggagaatggcgtgaaccagggaggcggagcttgc

SEQ ID NO: 10011 - DNA, 573 bp, Homo sapiens
aagctggatcaaggtgctccagaggagagttgaaagggtgatagaaatacatatgcacgcacacaccacacacactcacacactaacatgtgaagtcaacagacaaaagtaatctggtctagacaaacatacttgacgaaatgaaaaaatggtagaaacagtggactaatttggggtacaagaaagcatccagaaagcagttagtggatttttgcctctgaaaagtatttaatccctaaatgccctttatattttgtagcagcccacacataatttaatgtcatgtttatttatgtaaaatcctctgcatggcactgaaattgagtgaaacagccactgcataccccttgaggaaattaaaaggcaagccaaccaacagtgtcgcagacagagctagggacatacagataaccgaatcaacattagacacagcaaattgtagcacatggagagccctcgtgaagagcaaaaaactttttgtaaatttgctataccctcctgactctgtttctccacagagccagaggtcatttgtagctaagacataaaatctgcacctgagttgcaggactc

SEQ ID NO: 10012 - DNA, 333 bp, Homo sapiens
tgaagaattaacatttaaaaatcaagcagaggccaggcacagtggtgcacgcctgtaatcccatcactttgggaggctaaggtgggcggattacttgaggtcaggagttccacaccagcctggccaacatggggtttagtagaaaccctatctctactaaaaatacaaaaaattagctgggtgtggtggtgcatgcctgtagtcccagctactcagaatgctgagacaggagaattgcttgaacctgggaggcagaggttgaagtgagctgagattgcaccattgcacgccagcctgggcaacagagtgagaatctagcagaaattctggggc

SEQ ID NO: 10013 - DNA, 558 bp, Homo sapiens
gttctggtacaaggtatttccccaaggtcttacagaaatgtaaagggttgatactattctgagtgcatataaaacttttaaaactgaagaacattgtttagcactatacaaactatagcaataatttaagatctgccatagtggccttcttctgtgcctcagagaacttggaaatcatcagtagcttatgctaacataaaaatacattaaccatgagttacacattctcatatatatgttttcaaataccagcaatcatttcattaaaaataaaacaagcacttccacttatcttaaagactacttctcggctgggcgcggtggctcacgcctgtaatcccagcactttgggaggccgaggcgggcggatcacgaggtcaggaaatcgagaccatcctggctaacatggtgaaaccctgtctctactaaaaatacaaaaaattagctgggcgtggtagcaggcgcctgtagtcccagctactcgggaggctgaggcaggagaatggcgtgaacctgggaggcggagcttgcagtgagctgagatgtgccactgcactc

SEQ ID NO: 10014 - DNA, 374 bp, Homo sapiens
gtgactattgaaatgagatgataacttcccagaaactgcgtagaaataatcatcactttattaccctttgaaaagaagattgatagaaaagtcattcgaaagatggttcattaccatgccctagtacgatttctttactcacatctctctaaagcatgagaaagggaggattattctctaaggtcggaatttgaaggctgtttgcctctttgaagtctcggtatttaattttctgtagtcatttcttgggcaattttctaagaaactagttgaagctaatttatcataagttaaagtcaaatgacagaaaagatttttcccccttaacagcattttattccacagaggttagcttctgaaggaaaatgagactt

SEQ ID NO: 10015 - DNA, 446 bp, Homo sapiens
agtgatctgcccacctcggcctcccaaagtgctgggatgacaggtgtgagccactgcgcctcgtctaatttttaatatttttagtggagacagggtttcaccatgttggccaggctggtcttgaattcctgacctcaagtgatctgcccacctcggcctcccaaagtgctgggatgacaggcgtgagccattggtcccggtctctttactttcttaatgttctttgatgcacggcagtttttaattttggtggagtcaaaatttgtttgtttgttttttcctgttgctcatgctttgggtgtcatatccattggcaaatccaaggttcatggaaatgtacccctatgtcttcttctaagatctgtacagatttagctcattgttcgattttgagtcaatttttgtagatggtttaacatgggagtttgtggatgtctgtctgtctc

SEQ ID NO: 10016 - DNA, 642 bp, Homo sapiens
  misc_feature 420, 444: n = A,T,C or G
gtgagctaccatgcctggctggaaagaggtttaatgggctcacagttccacatggctggggaggcctcacaatcatggtgaaaggcaaaggaggagaaaagtcacatcttacatggcagcaggcaagagagtttgtgtaagggaactcccctttataaaatcatcagatctcatgagacttactcactatcatgagaacaacatgggaaagacccacccccatgattcaattacctcccaccggtccctcccataacacgtgggaattttgggagctacaattcaagatgagaattaggtagggacacaaccaaaccatatcagcagtcttttgtgatagtttttgttttcatgaatacaagtgtgagacctctcttcatggccttcctcagctctatttgtcagatttttctttcattntttttgaacttagtgacctcattntgattctgacaactttcttacttatcaacaccacaaattattgtattatccatatcatacccgtctccccgacttgaatgtaagctccttaaggacagggactttgttctgtccattgctgcaaccaacacctatattactttctggccacttacagcatatgctcagcatatattaacaacgtgaatggacttgatg

SEQ ID NO: 10017 - DNA, 561 bp, Homo sapiens
atcagccccagggcgctgtgccagaaaaaggactgcacagcaatgacagctcattcttctaccacggtctagcatgcgtgctgtgtgtgtggtgggtgttatttaggggaggaggaggtaacagtgagacacgtgttttgtgtgttaaggggacagagacactaagcttgacccactatgatgtctgagtcagtctggtgaaccaatcatgaaatgctcaaaagagagttgcacagttacaaagcctttgccattgaatggtggagactgtggcatcagtcccccaccctatcttctgtagaaaacagaatgagagtgcagttgcacagaggtggctccactgtagctcctcatgttatgcatggcagacattgctaatattcattccagttcccggtcaggcatggtggctcacacctgtattcccagcactttggggggccgaggcatgtggatcacctgaggtcaggagttcgagaccagcctggccaacatgatgaaacctcgtctatactaaaaacacaaaaaattagtcaggcgtggtggcagaagcctgtaatc

SEQ ID NO: 10018 - DNA, 455 bp, Homo sapiens
  misc_feature 361: n = A,T,C or G
cagtgttccttcctttagggtatgacacaggacatctttggaaatgaaggtcttatgacccaagatcagaaaggcaggagaagattagagtgctgccctgggcaggtgagaggagggcggaagaaggtcagagagagagagagagagagactctgttttctgaggcctacttctgaggcctaatgtgccccaacgttaaaagatagtgacaagggctatgggagttatgagccaggaactgtggacaaaatctagtatgtgttaactagttgtcttgtttaaacctaagaatatactaatataaaggataaaaaagaaatttaagtttggcagcataatgtaatttcagggcatatgattntatcacttactatctgtgtaacatttggcaaggaacctaacattacaaaactacagttcacttctattaaagtgggtataatcatgcttacctc

SEQ ID NO: 10019 - DNA, 515 bp, Homo sapiens
aggcgggagtttgcctagaccacactgtgagtttgctgtatatatccacgccttacacagtgaatgagaagatactcagggccgggcacagtggctcagacctgtaatcccagcactttgggaggctgaggcgggtggatcacctgagtccaggaattcgagaccagcctgaccaacatggtgaaactccgtctctactaaaaatacaaaaattagccaggcatggtggcatgcgcctgtaatcccagctacttaggaggcttgaggcaggagaatcgcttgaacctgggaggtggaagttgcagttagccgaaattggccccattgcactccagcccgggtgacagagactccgtctcaaacaaaaaaaaagatacttgccccagcgtggtggctcacgcctgtaatcctaacgctttggaaagctgaggcaggcagatcacctgagatcaggagtttgagaccaccctggacaacatggtgaaaccccgtctctactaaaaatacaaaaatta

SEQ ID NO: 10020 - DNA, 618 bp, Homo sapiens
ggaagccgtctgatgacaggatgagcctaaggtggggaggggaggatgcggtgagccacaggttctcaatgttcagagagccagtgtccttaaatagcgaggtgaagagctcaattaggaaccaaagccaaaaatgagctgaggcaagatggtagaacccaggcctggatctgagcagttgtcaaaagtctggttacaacatttgagagtgtggtgttcagctacctttttggattcagttgtagttttttatttgcatattctttttctttttgataaagctctatgaggactatgttttcaactccctagatgcatatagtcctgtactcagatataatgtatctaatctcttcccagatttataattgcaaaccataagccactttgagttgtgttccagcacctgccgaaggagacgactaaatgatatgaaccccattttcctcctaagagggcattcaaattctcttcctcttggattttatgaaatcagatttcagttggaagattctgtcacttggcctcttattgtcaaacacaggtaccttttaacgcagacttctactgagaaataattagagacagggtctcatggtcaggcgcggtggctcatgc

SEQ ID NO: 10021 - DNA, 534 bp, Homo sapiens
tacacatttctgaattatttgaattttttaacaggagcatatatgattcatattaccagaaatagcaaacatcaagctgaactgcagctaaggagtgtctgtgataaagagaaaactgtttgattattaaacaaaagacaattgaagcctcagttcttttaatttgccttgttcaattagttacttaactttatgaactcaagtcatacactgagaccctaaagttgtttttgttttgaattaatgccatatagctgaaagtgacaaacactttactcatggcagtatacagaaaattttcagggaagattaaaaggcatgaaaacagcaggttgtggtggctcatgcctgtaatcccagcactttgggaggccaatgtgggcggatcacttgaggtcaagagttcgagaccagcctggccaacatagagaaaccccgtctctactaaaagtacaaaaataagccggctgtggtggcgggtgcctgtaatcccagctactcgggaggctaagacaggagaatcacttgaaccct

SEQ ID NO: 10022 - DNA, 476 bp, Homo sapiens
actaggcttactgtaagagctccaaaaatattttctgacatatgttctacttatatgtcattatgtaaaaataaaacaaaattatactcatgcatttttaatattagcatttttttgactctattgataacatctgtattttccaactgcgaagtttgtgtaagtgatctcttgtaagatggaggtctgaaacataaacagtttatcacttgttgctggagtaacaattggcagagattgccctaaactctaatgacattttactctccccaaatcagatcgataggtttttgaagtgcactcatgttgaattagaacaataataaacagtttttaaagaaatgcatgaaaaatacaaagaaataacaaaaaataccttttaaaatacacatcttttcacctttttgaagcatttttacaaagttaaggggtgtgtgtctgtgtgtgtgtgtgtgtgtgtgtgtgtgtgtgtgggt

SEQ ID NO: 10023 - DNA, 447 bp, Homo sapiens
  misc_feature 342: n = A,T,C or G
gtagtggcatgatctcagctgactgcaacatctgcctgccggtatcaagcgattctcctgcttcagtctcccaagtagctaagattacaggcgcctgccaaccacacccagctaatttttatatttttagtagagactgggttttgccattttggctgggctagtcttgaactcccgacctcaagtgatccacctgcctcagcctcccaaagtgctggaattacaggcatgagctaccacgcccagccccagacttcaattctcttccttcagccttcacccactatgggctcatccaatcttagaacttagacctagaagttcacctggatcttatcttanactctaatctgttctgctcggcagggccaggtaaatactattaagggtaagcactcagcccaccacacacacctgcacaaaacaggagactgggccgggcgcggt

SEQ ID NO: 10024 - DNA, 540 bp, Homo sapiens
cctgtctctatgacattctgcttccaccaggaagccttctctgatagactcaactctgtgcttttccaaggccctattctcctttttaaaacgtacttctaaggatgcctagtctttttattcatacactatcttcataactccatgtaatggtcctattatttttatacagaataaaacagagacactaaaatgttaataatagaattcagtaactttttttaagaaacctattagaaatttaaaaatgtgggcaacttcgccaggtgcggtggctcatgcctgtaatcccagcactttgagaggcagaggggggtggatcacaaggtcaggaattcaagaccagcctggccaagatcgtgaaaccccgtctctactaaaaatacaaaaattagccgggcgtggtggtggactcctgtaatcccagctacttggggaggctgaggcagagaattgcttgaaccctggaggcagaggttgcagtgagccgagattgcgccactgcactccagcctggctgacagagcgagactccgtctc

SEQ ID NO: 10025 - DNA, 515 bp, Homo sapiens
atcagatgatttccttgaaagttatttttttaattttggggaactagtttccctggacctgcccgatatggttgctaaaagagctggcttgatcttgcaatgttgcaaaggtctagtaaaaagaccatacccttgtgcaaaagaaaataagccactttttcttcaaagtttcaaggtcgaaggagtcccagtgcttcaacatatactccatgggagtgcacattgaagacgatctgttacccatctagaaaaagaagtgagaataaaagcgtccttttagtctccttcctttcagtatgtgatccagggtggagatgaaaacaatagagggcatccccccaactattttctctctgttgctccaggattcccggcacctgcttaaatgtgccacccatgactgcaggcgtgaccctccaagctgtggctccagaggaactgagttccttggtcacgctgtccccaagcaatcagtactctgccttttatttccctttgaccttctagacttgcgt

SEQ ID NO: 10026 - DNA, 390 bp, Homo sapiens
ctggtgtgctgtatgtactccggaaggtcaagaaatacatacgggctacaaggaaaaatatatgaaatataaagtatgtttccgtctaaggtttcttggaaactctagttgaggcttttacaaatgtgctttttagcatcattcttccaaaagtaccttttaaaatgattctcaaggcttcacaatatatatatttttacaaatacttatttcccaacatctgtaaaagtgtaaatcttagagtattttatgctgaacttacaaatttggtactgaagacaagtatttcttgcagtctgccaaatttctgccacactggaaaatacacagatgattgtttaacattctgtgccatcagacaggaattatatttcacatcttttttttttt

SEQ ID NO: 10027 - DNA, 456 bp, Homo sapiens
gcactcacttcagactgggtgacagagcaagactgtctctcaaaaaaaaaaataaataaaaataaaataaaaatggctaatttttgtatttttagtaaagacgtgttggtcaggctggtcttgaactcctgacctcatgatctacccgccttggcctcccaaagtgctgggattacaggtgtgagccactgtgcccggccctatagattatcttatatttggtccttttcaggtttgaggatgcaaaaaatacatgtatacatgtaaatggttaaaaaaacattttgtttctttttctattagcactttttaagagcactggaaaactatgaaaagcttctgtaatgtagtaataaccgtatgtggagcatctgttttttatttgggttttcttgtggtggcatttttccttgaacacttatactgttcttctaccatttttttcctaccccagta

SEQ ID NO: 10028 - DNA, 356 bp, Homo sapiens
ggcacgaggcttcctccacctccagggttcaagcgattctcctgcctcagcctcccgagtagctggcattacaggcacctgccaccacacccggctaaattttgtatttttagtaaagaaggggtttcaccatgttggtgaggcttgtctcaaactgacttcaagtgatccacttgcttcggcctcccaaagtgctgggattacaggcgtgagccatcacgcccagccgagggtatcttttataccaacaaattatatgactgaggtgtaatggacaaatcctatgcacaaagtgagggtatctgaatatgtgggccggagccaaaaatttttagctacttttacacttaagtcag

SEQ ID NO: 10029 - DNA, 552 bp, Homo sapiens
ggcacgagaggcattaaacttgtacactgagttactaaacaacagactccatggtgagtttgagaactcccctctgtccctttctccatttccttcttttaattgtctgtgtgaaggctttggatcgtgcctcagtcattggcctacactttaccttttcctgaggcgtagatgattgaagcaagagtagagatccagaaaggagagtagttttccagttttgtggacatgtgattagttaagggacacataggaatgactgctttgccttaaactcagccatttagggattaatcttcaaccccaaattttatcattttattattttacagctgatgtatacacatttaatgcattgattgaagcaacagtatgtgcgataaatgagaaatttgaggaaaaatggagtaaaatactggtaaggaggaatcctcagtttattttttaatagggcttaaatactctttaccagaaatacatgggctggccaggtgtggtggctcaaacctgtaataccagcactttgggaggccgaggcgggcagatcacctg

SEQ ID NO: 10030 - DNA, 635 bp, Homo sapiens
ccatctctactaaaaatacaaaaattagttgggcgtgatggcgcatgcctgtaatcccagctacttgggaggctgaggcaggagaattgcttgaacctgagaggcagagattgcagtgagccaagatcgagccactgcactccagcctgggtgacagagcaagactccatctcaaaaaaaaagaaagaaagaaagaaagagtttttctggctaggtgtggtggcttatgcctgtagtctcagctacttgggaggctgaggtgggaggattgcttgagctgggggagtttgaggctgcagtgagctatcacaccactgcactccagcatgggtgacagagcaagaccctgtctcgggggagaaaaaaaaatgcaaatgctttcctgacagaactaagagagtttggaactagggttctataaagtcagccctggtgtgggacttctgttattacagagagtacagaaagtgtcctaaaaggacagctgggtggctgggcatggtggctcacatctgtaatcccagcacttcgggagcagaggtaggcggatcacctgaggtcaggagttcgagaccagactggccaacatggtgaaaccctatctctactaaaaatacaaaaattagctgggcata

SEQ ID NO: 10031 - DNA, 698 bp, Homo sapiens
gtgttttaactgctttttgtacttaatatcttaaacatgcttggaattgattggacagaataaaaccaagataaatatacaaaattaaatgattcagggataatgtgggttatgccttgcgtgcctgtctgaggagtttggacttgattctctagaccaaggattggcacactgtaacttgtgggccaaatccagccttctgcctgtttttataaataaagttttattggaacacagccacatcaatttgtttgcatattgcgtgtgactgttttggtgctataatagcagagtaggggataggcttgcagggcttaaaaaatctgagcttttacacaaaaagtttgccaaccctgatataagtagtgggaagccatgaaagggttttgatcagggaggtggtatcttcagatttgtgtgtcagaaagcttactccagcagctgtgtggaggatggatcggagaatacaatgaacagggggatggcagagggaatgggagggaagggaacagcagaaagacattttggacatagaatctactataagcctgggtatggggtatgggagggagaggagccaaagacagttttgtaaaaaaactattaaacccatataacctcccccaaaattcagaataataacacacccgaccacaccgctaacaatcaatactaaacccccataaataggagaaggc

SEQ ID NO: 10032 - DNA, 349 bp, Homo sapiens
ggcacgaggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcatagcaaatgaacaagtgccattcaagggttagaaactgctcagccacagggtcccagtgtctgagtctggaagagtctttacagatttgttcactctctgagggatcctcctggctctggttacatactttcagggacgg

SEQ ID NO: 10033 - DNA, 350 bp, Homo sapiens
ggcacgaggcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaaggcgaattgcgg

SEQ ID NO: 10034 - DNA, 585 bp, Homo sapiens
ggcacgaggagtgaccctgggttttgtgtttttactctgtggatgttgtggtcacgctggatcatgttgtgtggaggcttgggagcatgtgttggaggaacagttgagattttaattttatttttggtggcttttttggtacatccaaccctttcaggttaattaaatgccaggtagagctagcccacaagtggattttgttttgaaaatgtgcctgttttccaggagccctttgtggcagcctggtctggttgcccagatatcattttggcttcttggtgccttagtgcctgggatgaattggcctgcctgctgcagtctcttctcctcagccctgatatccgccaactgggtggctttgatgcctctgctgagggctctggtttcctgccagtctgggaggcgtgggatctcatgcgtgggaaaggtaatcaagcaataaaactaagcctgggcgtgagaggtggattaaagtgggcaaggaagaagcaggggagagggagggagccagctgtccagagtggccggaagaggcagaatgtgggctccatcctggctgggacctgtcagcccttgtgagaactt

SEQ ID NO: 10035 - DNA, 531 bp, Homo sapiens
ggcacgaggccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtagtgccattatctagcaccctgattttttttttttactataaccagggtttcattctttttccactgaagggtgacattttgttagtacatttcagggtagccattcatttctagctgtccataggatgaaggagagatcagatccttgaacatgtcttacatgggttgctgtatttagaattataaacatttttcattattggaaagtgtaacggggaccttctgcatacctgtttaaaaccaa

SEQ ID NO: 10036 - DNA, 476 bp, Homo sapiens
ggcacgagagagaactagtctaagacatagaggggatagggacactgtaatcaggtcacctgtgaaagaaactggcattaaaaaggtaagaatttttagacatgcaggcatgagtcagccatcagtgattaatgactatgactgtaggctccattctttgtgtttcttctgtgtattagtttttcccatgaaatatttaatgcagggtgtttttttttttccacaaagctattttacattatttgaaaatacagcccgagcgtgggggctcacccctgtaatcccaacactttgggaggccgagggggatggatcacctgaggccaggaattcaaaaccagcctggccaacatggcaaaaccgtgtctttactaaaaatacaaaaattacccaggcttggggacgggcacctgtaatccaagctactcaggaggctgaggcaggaaaatcacttgaacccgggaggcggaggctgc

SEQ ID NO: 10037 - DNA, 553 bp, Homo sapiens
tataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagttt

SEQ ID NO: 10038 - DNA, 495 bp, Homo sapiens
ggcacgagcagtggccgaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgc

SEQ ID NO: 10039 - DNA, 528 bp, Homo sapiens
ggcacgagcttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctggga

SEQ ID NO: 10040 - DNA, 539 bp, Homo sapiens
ggcacgaggtcaaaacagcctcactccctgaatgcaggctcagggccatcagccaggctgacactccaggaggcacagtgggtgtttctggtccacgcccagcgtggaaatcatagtggtgcacatgtactctgcgtgggcattgcggcagcatccgtgcttggacctcaccgcctttggggcccacgtgggattcctgccacatcgtcctcttgccctgcaaagtcggtgcagcccctcattgttgacaaagaaaccaagaccctgaaggttcagaactgcccatgatggtggcaccggggcttgaaccccggctgtggtggtgaccggcgactggctctgtgtgaggttcctgtggccgccacgacaaaggaccgcaagcggggtggcctgatgtagcagaaccagattcgcttgcaggtgggggcagggcgggctccttccgccgctctggctctctgcagctgcatgtggcctttccctctgtccctgcctcaagtcttcctctcctttctctcatgaggacaccagtcattgga

SEQ ID NO: 10041 - DNA, 515 bp, Homo sapiens
ggcacgaggccagcatggcaaaaccccatctctactaaaatacaaaaattagctgggcatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcaaaaaaaaaaataaaaacagtgaatgggtgtaggtgtgatggaattcactttacttactaaatggtttcgggaggttgtttctccaggtaaaattgtcgcctttctggtcccattcccaccttcaaacattatatgcaaacagttttaaaaaatcttacagttctaaaaggcttgtgacaaaaaaagaggcagtccctctttcacattgacagaaaaaacttcctctttcaattctagtagttgaaaaatttatatttccaaattgtatgattataccgctactttttgatacatcaattatttattgacttcctact

SEQ ID NO: 10042 - DNA, 65 bp, Homo sapiens
gctgcgagaacacgacagaagggcgctgtggctcatgcctgtaatcccagcactttgggaggctg

SEQ ID NO: 10043 - DNA, 388 bp, Homo sapiens
ggcacgaggtgaagacaagaaaggggcactattttaacacaaccttttcccgtgatcaccaccgaaaattactgacgagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattga

SEQ ID NO: 10044 - DNA, 547 bp, Homo sapiens
acagaagggagccacactgcctagagagtaagcagagagagaattgtcattaacccaaagaccatcttcgaaaacagactggctgcggctgagtgcggtggcacacgcctgtcaccccagccctctggaaggccgaggcaggaggaccacttgagcccaggagttcgagaccagcctgggcaacatggcaagaccctgtctctatctttctaagtaaaacaaaataaaaagctcagaccggcagcacatggttctttccagctgttcccatgaacaggcttcaggacaagcccaggcaaaggcagggagaaatggggtggggacccccaggctcacccccttgtctgctgcgtaggtggagttggtcacaaaggtcacaggctgggaggggtccaaggctttggtgtgagcaatcaccatcctgtccacaaaagagagaagacacaggttccgtcagtccgggaaaggctcagacaccctcccatcctctctgtcccatcttcccctgccagaacacaactgggggccaggcatgatggctcacatc

SEQ ID NO: 10045 - DNA, 547 bp, Homo sapiens
ggcacgaggtggcgcgtgcctgtagtctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggttttgtaaccaatcgataggacagttctgccacccaggacattcccctctgttcctctgttcctctcttctcctgccccctagcaaccactggtgttttctgtccctcttgttcattgacatttattttaaaataaaatattttaaaatctactttttggtgtacagttctgagttttggcaaatgcagtcaagtcactaccaccaccacaattaacagctatatcaccctccagtaaattccctgtggtcagctccttccccaccttttaccgtggcaaccgtcaagctattctctgtccctataccaggtgtcatcaaatttttttctggaaaggcccatgcagtaaatagttcaagctttgtgggc

SEQ ID NO: 10046 - DNA, 459 bp, Homo sapiens
aattattaagatttattggttggcatcatgtcattcccagctataactcttaattttcctaaaatgctttctgtaaatgagtgctgtatttatatctttcatgtgctttaagaatctctctcatttgattgggacacctacaaaatagcaatagtagtagtcttttataatactctagaattcttttttttcaagatggagtcttgctctgtcacccaggctggagtgcagtggtgcgatcccggctcactgcaagctccacctcccgggttcacaccattctcctgcctcagcctcccaagtagctgggactacaggcgcttgccaccacgccaggctttttgtatttttaatagagacgaggtttcaccatgttagccaggatggtctccatctcctgacctcgtgatccgccaaccttggcctcccaaagtgctgggactacaggcgtgagccact

SEQ ID NO: 10047 - DNA, 645 bp, Homo sapiens
ggcacgagggtggtttgtgcagtgacatttggcagtgttttctcggcaagcgagtctttgaggctgccctcatgctgctcagtgggcacaccaagaacaagagctggccagggatgacggacgcatctaggccttctcggcctaagggttacattaattatacactctggaggtgacttgacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccccgacgctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccg

SEQ ID NO: 10048 - DNA, 556 bp, Homo sapiens
  misc_feature 101, 107, 556: n = A,T,C or G
gcagtccttccacttcagcctcccgagtagctgggattacaggtgcacaccaccatgcccagctagtttttgtagagatggggttttgccatgttgcccangctggnctccaactcctgagctcaatctatccgtcctcctcagcctgccgaagtactgggattacaggcgtgggccaccactcccggcttccaaggcaggcatttaaatgttataaatagggagataagcaagaaccctgttggacctggtagaagcaaacatttattagtactattacgttgtttaacatatttgccgccctctatattcatgtcctcccaaaattattaaacaacctactcttatagttatttggcttatttctcacgaggaatataaattagtaaatattattgggccgggcgcggtggctcatgcctgtggggccagcacttttggccgaccagcggaggaagaccaccaagccaggactttgagaccggcttggccccacggggaagacccggtggtactaataatacacaaaaatgattggcattgtggcggcggcccn

SEQ ID NO: 10049 - DNA, 571 bp, Homo sapiens
cagtggctgttcatgggcacgtttatcacatatggccccagttcctattgcctgggctggttcaactcctgggctctagctatcctcctgcctagacctcaaggtattgggattataggcataagccaccacaccctgccagatttgtgcattttaattttggcagattcttccaaacactcccaagtgttagaccactttatttgttctggaaatgtacagagtacccatcttcttataggtaggttatcaaacttggatttttgccaatggaaaatgaaaaatgggctgtgtgtgctggcttccacctgtaacccccacattttgggaggtggggccaggaggctcacttgagcctaggaggtccaggctgtggtgacctgtgatttcaccactgcacaccatcctggatgacagaccctgtgtccaaaaaaggtgaaaaaaggctgggtgtcatggctcaacctgtaatcccagccctttgggaggccgaagtgggctgatcagctgaggtcaggattttgaaaccagcctggcgaacatggtgaaaccccatctccactaaaaatac

SEQ ID NO: 10050 - DNA, 274 bp, Homo sapiens
tggagtgcagtgatgtgatcttggctcactgcaatctctgcctcctgggttcaaatgattctcccacctcagcctcctgagtcgctgggattacatgcatgcaccaccacgcctggctaattttgtatttttagtagagatagggtttctccatgttggtcaggctggtctcgaactcaggtgatctgcccatctcggcctcccagtcgctgcgcctggccttgatttactttcttttttttttttttaaaaagggattccccttttttccccg

SEQ ID NO: 10051 - DNA, 478 bp, Homo sapiens
agacgacagaagggtacggctgcgataagactacagaagggtacggctgcgagaagacgacagaagggtacggctgcgagaagacgacagaagggtacggctgcgagaagacgacagaagggtactgctgcgagaagacgacagatgggtacggctgcgagaagacgacagaagggtacggctgcgagaagacgacagaagggtacggctgcgagaagactacagaagggtacggctgcgagaagacgacagaagggtacggctgcgagagacgacagaagggtcggctgcgagaagactacagaagggtacggctgcgagaagataccgaagggtacggctgcgagaagactacaaaagggtacggctgcgagaagacgacagaggcggcttaagtgttcttatgtttcatctccaggggctgggatacagaacccgcacacttcagttttttttgtttttttagaacgtgtttgcg

SEQ ID NO: 10052 - DNA, 556 bp, Homo sapiens
gtttctataaactttaattacctctgatgaggagtgtatcccctcatcacattcaccccaaaggtacagaggagttcatttttaaaaatgtgttagagcaataaaaggccattagagggagggaggatggggtgtggaagagacgagagagcgagcgagagatagagaaaacacactagctctccctgctggaataataggcttgaaatatgaggaagttgatcaactgccgctgccttccaaaaacagattaatccaccttggtagctttcctttcagagcaagcttttggctctgtcgactttctctatcagcctgaactcaaaaggacacaggccacatgccatctgagcttaagagttattttgtgtgttgatctgagaacttcacattttaaaacaatgaattcatgtttctactgtttgttgctgtctgtggatttgctgatataaagaggagagtcctagcctggtcatttaatgaataattctaaggaacctgaacttctccagggtgcccttctacatctgcagtggtggttctcagctggggtgac

SEQ ID NO: 10053 - DNA, 620 bp, Homo sapiens
tccgttgctgtcgggattgtattcgggctggccagcatggacgagctctcatggaagcatgcaatgaattctacaccaggattccgcatgactttggactccgtactcctccactaatccggacacagaaggaactggtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatc

SEQ ID NO: 10054 - DNA, 373 bp, Homo sapiens
cgaatccgtgctgcgaacccatagaaaatgatcctgaggcaccgaggatggttataggacgtggtctgctgctgcatgttgcattactgtatgctgggtttttggtactctttctcaaggctctgttattagttggtaggctccagtaatgaatatagaggactgacagagtgggattaacttatttgcaattgtttcctactgaaatcaaatgcacggttttcccaatttaagacttggtcccttgtaccttgatttgattcagaaagccatctgtgatgtttttgtttcctggcgcctgcaggaaaactcatttgtcatgagttacaattaccttgcagtcattgctatgtggttgtagcacactcattgc

SEQ ID NO: 10055 - DNA, 623 bp, Homo sapiens
acctgcttctgggtcggggtttcgtacgtagcagagcagctccctcgctgcgatctattgaaagtcagccctcgacacaagggtttggacacttttaagaaacaaagatagttttctgaacattctgtgtcctgcctgtctcctgttgattcgcagatgtaatatcgagtattcatcaactggtctcaatttcctgaacacattcactgtatccctcattgtaaccgttatccccctgcttcaaaatgtgccagttccacttggtaataacgttgggaaaatgcaggtttatgaatgatgtggacttttagaggatcaaatcaataaattggattttttattttttgagggcagctgccctcactgttttaaataaagaatcttacataagaatgttgacaacattcacagtaagccattggcagaaaattgatctgcatgtcctagaccaatgattacaaggtgtctgtggtttagggggcccagcccatcattccttttccccttggcactcatgagagagatgccaagttcagtgtggatttttcttggtgctctatggagaaatggagtctgtgtgcttactgaagagtcccaaaaaccagagaccattttcatttact

SEQ ID NO: 10056 - DNA, 573 bp, Homo sapiens
caacttctctcaccgccatggagttcgacctgggagcagccctggagcccacctcccagaagcccggtgtgggggcgggccacgggggagatcccaagctcagtccccacaaagttcagggccggtcggaggcaggggcaggtccgggtccaaaggtaagtcgcctcatcaccggctgcggagaggcgggaaggctggggttgcccctgaccccagggtcctgccttaggcctccaacttcagggggctgggtaaggggcgccgcctcactgccacacctccatccagcaaggacaccacagctcttccgactccagcagcagctccagcgattcggacacggatgtgaaggtaaggggctctcgccagcgtccccaagcacgtgccctgcaccccagagaggcgtccccgcactggggctggcggggagggtgcggggagtggtccccctgtctcgcttccagcccagaaccatctcttctctcccatccctgccctcggccccacagtcccacgctgctggctccaagcagcacgagagcatcccgggcaaggccaagaagcccaaagtga

SEQ ID NO: 10057 - DNA, 149 bp, Homo sapiens
gtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgc

SEQ ID NO: 10058 - DNA, 355 bp, Homo sapiens
gcatggtcatttgtttgggaggtaatgataggagcagaaatgaaaaatctttgagaagattgtgaaattggaaagtgtggagttctagaacagaataaattctagagttagaggaggtgctttttcatgaatgggtgtaccgtgtgttgagagagtggagtgagaaatgtacttctttgatctgtttcacatagaagcatgtatcatatagaaattcagtggtggccgggtacggcggctcacgcctgtaatcccagcactttgggaggccgaggtgggtggaacacttgaggtcaggagctcaagaccagcctggccaacatggtgaaacccctcctctactaaaaaattaact

SEQ ID NO: 10059 - DNA, 348 bp, Homo sapiens
ctagactctatgattgacagggtgaccagctgtcccagtttgccctggggcacaggattattcgtgctgaaaatgagaaagtcctgggcaacctgggatgaattggccaccttcactattgatccaacttcccaaatgctttgtctacattgctggtatctggctcggaggaagccctgtgggaaaggctgtgagtgtgttgccccaggttccacaggacacttagagtttgggggacacctgccgtcaacgcactgcaacaatctttagggatgttaattgttcctcaggaggcatacgtaggaatcacatccaccttaaacatgcccacttatggcatttgggctc

SEQ ID NO: 10060 - DNA, 408 bp, Homo sapiens
cgttgctgtcgcgtcaatgccgagttgcgcagtatgtgggcgacctgacttcttttgagcagttggcactacccgccttgaggaatgccaactgcaataatgccccagggctaaaagcgggcgtgatcgatgaaactgagaacatggacctcttctctcaccttttcattcaagctggacgtcagacgctgtctaccccagggactataatccttggcacaatcccagttcctaaaggaaagccactggctcttgtagaagaaatcataaacagaaaggatgtgaaggtggttaatgtcaccaaggaaaacagaaaccaccttctgccacatatcgtgacgtgcgtgcacagcaccatgaagtgaatacacgtgcattcctgccttccgtgaaggagagcccagttcc

SEQ ID NO: 10061 - DNA, 598 bp, Homo sapiens
atgctaactgagttaattagatgagattctgtagagaaaatggacactataagaaataatagtgtccagaactgagttataatgacctctaatatttaatgataaatgaaagaagaggaactgatgactgaatctgagaagaaaccaataaacttgtaataacagaagaacaaacccaggtggtgctaaagaaatcacagttcatcaaaaaggagggacaagtggacttgccttgttaaagatggactgccttaccaaatatgacaaatattaaaatatgtttagatttcaatgatgaccaaatatgtaaataagacactggaatttattcgtcaaattcctgataatattaaatgttacatgagcaattggatgttaaagcacaacttttcggctgggtgcggtggctcacgcctgtaatcccagcactctgggaggccgaggtgggcggatcacaaggtcaggagatggagaccattctggctaatacagtgaaaccccgtctctactaaaaatacaaaaaattagccgggcgtggtggtgggcacctgtagtcccagctacttaggaggctgaggcaggagaatagtatgaaccc

SEQ ID NO: 10062 - DNA, 563 bp, Homo sapiens
caaatacctggagtacactgcctcactatccttagtcatgctagctttctcttccctgcagtatagatctgccaattcaaatctgtatggcaccagggctggcaaacgcagaatgattcaattagtaatatggtattgttaaattattataaagcgggccaggcacggtggctcacgcctataatcccagcactttgggaggccgaggcaggcggatcacttaaggtcaggagttcgagaccaacctggccaacagggcgaaacctcatctcttctaaaaatacaaaaagtagccaggcgtgctggcggatgcctgtaatcctagctactcaggagggtgagacagaaggatcgcttgaacctgggagacggaggtggcagtgagccaagatcataccactgcactccagcctggggaacagagcaagactctgtctcaaaaaaaaataaaattataaagtgaatgaatgactatgggatgcaatgaccgactttacggtgaatagaaaattcaaaacggctctgaaatcaactccaaagaatgttgagatcagtgctgaaat

SEQ ID NO: 10063 - DNA, 521 bp, Homo sapiens
ttgctttcaatgatcctgatttcctctctccaccgcagtatcttgattgcagtaaagcacatttcctcatcattctttccacacacattactcattcccatttctatccttttgcccagacattttctagaatttactcttacacattctctagcccagatcattagctgtaacaaatgagggttgcctcaatcatatcttttgtctcctaattgaaattctatcttgtattatttgttgcttcatatcagtgaagttgtgtccccaggtatataattagaacatttatagtaagcatcatatcttaatttctttaggaagtgtctaccatgtaaccacagatgaaaaataaactcttgctgattaataatgaatgtgattggcccggtgcagtagctcatgcttgtaattcctgaactttgggaagctgagatgggcagatcacttgaggtcaggagttggagaccagcctggccaacatgatgaaatctgtctctactaaaaatacaaaaattatctgg

SEQ ID NO: 10064 - DNA, 593 bp, Homo sapiens
aacattcttttatgtgctctaaaggcaaggtttctatgcagttacctttgtaaatagaataagtttctatagaatcagtcttaacttttatgagtcagggattcagaaacttgtggggtggcctgtgataatttttcctccttcaatgatatctcgagtttgagaactctcgatgcaggattatcatgttggaaagctggctgtgatctccaggtcagtgaactgcagttctggcctccataggagaggtgtggcaggtggtggtctatctctacttcacagatggtgaaagagggccagacaggggagaggaccttgcttgggatcatggtggtaagctaggggccagttagcagaaggatgaggccttgatttctcactctgactggtgagctctgttgtgggttgagtcgtggcctcatcaaaaaggtatgttcttggccgggtgcggtggctcacacctgtaatcccagcactttgggaggctgaggcaggtggatcacttgaggtcaggagttagagaccagcctggccaacatggtgaaaccccatctctactaaaaatacaaaaattagccgggcatagtggcaca

SEQ ID NO: 10065 - DNA, 89 bp, Homo sapiens
gtcctaaagtaaaaactgtctccccaaaaaaggaaaattgcaaatactacattgattttagaaaggttaactcccatcttggtcacatc

SEQ ID NO: 10066 - DNA, 595 bp, Homo sapiens
ggcaggcggatcacctgaggtcaggagttctagaacagcgtgccaacatggtgaaaccccgtctctactaaaaatacaaaaattagccagacgtggtggcgcatgtctgtagttccacttaggaggctgaggcaggagaatcgcttgaacctgggaggtgggaggttgcagtgagctgagatcccaccactgcactccagcctgggcgacagagcaggactccgtctcaaaaaaaagcaaaacaaaaaacaaaaccaaaacaaaagaggtgcaggccagaattgtccccgtggacatagttggtcaattagattgcatactttaatccagcctcagttggtgtgtctgggttttctggctaggaagaatgctgctgtggaatgtgctggaacagatccttacgtgcgctgtgttggagtctttccaggtcaggggttctcaaacggatttcaggaccctttacatcatccagaatgatccaatagccccaggagcctgtgtctgtgtggattatgtctgccggctgttagtgtgttagaagttgaggccaggcatggtagctcacacctgtaatcccagcactttgggaggctga

SEQ ID NO: 10067 - DNA, 128 bp, Homo sapiens
ctctaggagcttccaggtcacttctaactgcctgcagctctcccttctcggaaccctgctgcattcagagtggagccgtgctatttagctcttttttcttgtctttttttttttttttaaaacggggt

SEQ ID NO: 10068 - DNA, 376 bp, Homo sapiens
gaggcaagctgcaagaaggccatggggacaatgtgcagagcaatgaagcctcctgcccatagtgactgtacccgcgacctggtggtgaccaggcaggcatttgcacctgctgggctccagagctccccttctttcttcactcggtgacagcaaaccaagacttgggtcacatcatttctgggtaagtatgcagagatgctgaaagaacagtgggagcaaaaagaacaatattcttgaacgtcttctgttttctctatgacccttagaaacccaaagaaaatttcacagtaggaaaataatccattgcacaaactgtatttttaaaggtgagagctggccgggcgcggtggctcatgcctgtaatcctaccactttg

SEQ ID NO: 10069 - DNA, 54 bp, Homo sapiens
gtggatgtttaccgtgtgttatataacttcctggctccttcactgaacatgcct

SEQ ID NO: 10070 - DNA, 157 bp, Homo sapiens
gcgatgtctaaaaccaaatagggaaaatataaaaccaggctgggcaaggtggctcatgcctgtagaatgcttggcacaatgcctggcacatggaggccaaggtgggaggctcacttgagaccatcctggacaacgaagtgagaccctgtgtcaaaag

SEQ ID NO: 10071 - DNA, 416 bp, Homo sapiens
aaagccggctatgggaagccatgtcatacttggctaccttcctatgttccttctcacagcaaaactcttggactgatcatttgaagtcacccctctgtgtcttcttgtgaaatggcttgggcgtctctgggctctgacttgctcatctgggaagagatggggtagagggagttggattataaatcatgcttcactcagtcaacagaatgctactcaggcactaaaaatgatggcgtagccctacgtattctgacatgggaagatggccacaatatcttattatgtggaaaaaactagttgcataggatttatggtttgattacattttagtaaaataaattcatttatggtggtatatgcaaagaaaaaataatgccgggcgcagtggctcacgcctgtaatcccagcactttggg

SEQ ID NO: 10072 - DNA, 515 bp, Homo sapiens
atgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattgaggatgttgagttatgttactaatgtatgcaactttaat

SEQ ID NO: 10073 - DNA, 309 bp, Homo sapiens
gatcaagcagattccacgaatcctcggcccaggtttaaataaggcaggaaagttcgcggtccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggac

SEQ ID NO: 10074 - DNA, 599 bp, Homo sapiens
caataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaaccgcaaaaagggacaggaggctgaccttgaggctggtggggaggaagtccctgaggccaatggctctgcagggaagaggagcaagaagaagaagcagcgcaaggacagcgccagtgaggaagaagcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatg

SEQ ID NO: 10075 - DNA, 643 bp, Homo sapiens
ccttgaatatgaagatgctagaaagagctctgcatttaagcagagccttgtgcaattcccggaccaaatgctgaaactgcaagagtgccctttaaaagaccttcttaggcatgtgacttgttctctaccagaacctttgggcaacatgaaggaagtcaaaggcatttactggcttgctgttgctgcctgcacagcacctgaccctcaaccagcgtgtttgctcctgcttcagtcaactttatatgctttggtcctgtcagataatctcggctcaatgagcatttttcatgctctacctctctctggtctacaggagattcagattggctttggtggacagagtgttcgattcctgagctctgcagagggtcttctgctcactgtattcagttacaacaaatacctctctcaacagctgtgtcgtgacctcctgtgtgtcctgatgccagagcctgatgccgctgcctgcgctaatcatcccttgctccagcaagatctggttcagctttctcttgattggaaaacagaaatccctgatttagttttgccaaatggagttcaggtgtcatccaaattccagactaccttggttgacatgatttactttcttcatggaaatatggaagtcaatgtcccttccctg

SEQ ID NO: 10076 - DNA, 376 bp, Homo sapiens
ccaagccttctcgcggggagggaatttcttctttctgccgcctgttacatccctgtgtgagaaggtctgtgagctgagcccacatcactcgttctgctgcccacgtgtgcttccatcttcactgtggaaaagtcattttgaactccccggcgactgcaaattaagttatcaaggacagatgggactgggttgaccattccaaggagtacagttacttgaagaatctggaagcaataccgagcacatttgttggcattaattcattggagcaataatgctgtacgtagaaagtatgttgcttttttaaaaaaacatcatcagttctgagcatttgtagcaagtgaactctaacttggaacggatgataaattcttct

SEQ ID NO: 10077 - DNA, 300 bp, Homo sapiens
ggccttccagatcgtgctgtcccacctacctgcaccgccgaggccttccagatcgtgctgtcccacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctcccttggggctgcccctgtggagggggatcccgcctctagaactatagtgagtcgtattacgtag

SEQ ID NO: 10078 - DNA, 626 bp, Homo sapiens
ggcacgaggtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccacacccagctaattttttttgtgtttttagtaaagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgct

SEQ ID NO: 10079 - DNA, 400 bp, Homo sapiens
cgttgctgtcgattttaacaagctctttgctagagagactgcagtgacagatggttgggagtttgcccctaaagctgtgacaccaatcttctaatgagcatatttgttctgggtcgccctgccagattctttctctatttcagaaagggacaacagaataagtgacttcaaaagaagaccatgaggaagagatggatgaagatatataagacttagatcactatgagatgaaagaagagcctattattgagaacaagttggaggatgaaggaactgaataagaaaattgggcaatattatagaaaattaggaagactgaaaggttgaccctgatagtcctttgcacagtgatctttatatcttaacaagaagcgataggagacattcttgttatctttca

SEQ ID NO: 10080 - DNA, 381 bp, Homo sapiens; identical to SEQ ID NO: 222
  misc_feature 381: n = A,T,C or G

SEQ ID NO: 10081 - DNA, 557 bp, Homo sapiens
tgctctcaaactcctggcctctagcaattcacctgcctcgttcacggacttttctgatcttgcttgtctctgtttagggtttctggagtcagaactgctgtcaggatgagtgggaagggcatcccctcacctgtctgtgcctcagattcctcatcttcaaaatggagggaataaaactacttaccttgaagggctggtgaaaggttaaaatgagatgtaattagtttagacattacattcatacataattagtttagaatagaaactggcatgtgttaagtgttaaaataaatattggcagcttttgttgctttatctctatgaatcctttgcagaagttagagatcacggattatctagaggtaggccatggtggagaattgagaatgagatgtggagtggtgattggatgaggaagtcatataagctgcaggaagggcgagtgactgaggaagcttttgtggagtcctaattagagaaacagagttaggctggcaggaccaagggaaagcaaagagagaaagcagataaacggccgggtgtggtggctcacgcct

SEQ ID NO: 10082 - DNA, 500 bp, Homo sapiens
  misc_feature 355: n = A,T,C or G
cactgcaacctccgcctcccaggttcatgccattctcctgcctcagcctcccgagcagctgggattcccggcacccaccaccatgcccagcgacttttttgtatttttagtagagacagggtttcactgtgttagccaggatgttcttgatctcctgacctcgtgatccacccgcctcagcctcccaaagtgttgggattacaggcgtgagccaccgcgcccggccgagcagataggttatcaaagagctgagcaaagattgtagcagtctcacagtactagggagataaaggtaggaattcaggactttccagggtgcacaggctttggtaaatgcctcacattatcagctganaacctagaaggtctactccttagaaggtctataacctagcagtaagacctacatccttggagtaaggaccacttccaaaagtctctaccacaggtacgagaactatatctttggattaagagaaaactggagaaataccagctta

SEQ ID NO: 10083 - DNA, 596 bp, Homo sapiens
ggtttgaaacctacaggaaaatattggagtaaaaaaaatatagaaaatcaaacatcaaaggaaatgctggaagtgtgggaattgataaaaggagcacaggaaaagtgtgcagagcgttgttacccaaagtgctgtgggaattttatacacatatgaatacagctcacaaaacacacaaatatttttgcttccctggatcatttactggagtcttttacatacacattctgaagtataaggtatgcagaattttctaagcgtatcatagaattccattccaagaatacatttcaggaaaactattgtcaatcagggaaacattggtgcagaatagtaagaaaagaaatacccattaagactagtagttacacagtggacatgaaaatactaggcagcaaggagttattaaaaagaaagcatgggctgggcattgtggctcatgcctataatcccagcactttgggaggccgaggcgggcggatcacctgaggttgggagtttgagaccagcctgaccaacatgaagaaaccccatctctactaaaaatacaaaattagctgggcatggtggcacttgcttgtaatcgcagctactcg

SEQ ID NO: 10084 - DNA, 550 bp, Homo sapiens
tagtcccagttactcaggaggctgaagcacaagaatcgcttgaacccgggaggtggaggtggcagttagccgagatcacaccactgcactctagcctgagtgacagagcaagactctgtctaaaaaataaaaaaagaaagctgctttctgaagacagaggagcttccacaactgtctttttccagcatttaaaaatcttccactaaaccatctggtctctcttagcccacaccttctccagaccgaagcaaaactgttagcactttttataagaactatcaagcataagaggttatttaccttgaagggataatcatcaggatatagtcagtgatcgtttattcacatatcaaactaaattcaacagatagctatgaaatataggctgggcacggtgactcaggcctgtaaacccagcactttgggaggccgaggtgggcagatcacctgaggtcaagagttcaagaccagcctggacaacatggcaaaaccccatctctactaaaaaatacaaaaattagccaggcatgatggcattcatctgtaatcc

SEQ ID NO: 10085 - DNA, 280 bp, Homo sapiens
acaagggaactgggcaatgccttggtgaaattcaaacactagaattgatccctgaagagacagaaaccctaagcacaccatgaaaccaccggagaaagggaaaacgggttgagagatctactattttgaaaagtcaggcctggcgcggtggctcacgcctgtaatcccagcactttgggaggcgaagggagaatggcgtgaacccaggaggtggagcttacagtgagccgagatcaccccactgcactccagcctgggcagcagagtgagactccatctc

SEQ ID NO: 10086 - DNA, 514 bp, Homo sapiens
agagacagggtttcaccatgttggccaggatggtctcaatctcttgaccttgtgatccaccctcctcagcctcccaaagtgctgggattacaggcatgagtcaccatgcctggcccacagtgaccctttaaaggaaaatgggagggacctacctcggaggttgtgcagaaaatgttggcttccccagcactaggtttggttccctcctaggtcctcccacagctgtgctttgacacatagcagtctctattaaagtgcctctttaatttgtctgtcattgccaccagaccacaagatactttggggcagggctgtatttcattcatccaggtatccctagcacctgcagctactctgtaaacagaagaaagaacagtaggctgggcacagtagctcatgcctgcaatcctagcactatggggaggccaaggcaggtggattgcctgaactcaggagtttgataccaccctgggcagcatggcgaaaaccctgtctctactaaacataaaaaact

SEQ ID NO: 10087 - DNA, 411 bp, Homo sapiens
actagttctctctccagaaaactacaactccaggagaaacaaaacttctggcctctgaaatctatgacattcttcagtcctccaatatggcagatggtgatagttttaatgagatgaattcacgtcgaaggaaagctcaattttttctgggaactacattcaaacgtgccaaaacagtggttttgcatatagatggccttgatgatacggctttggcatcagcaatagcatcaaccaaggttatgaaagctcagcaagttgtgaaaagtgaaagtggagaacatatgttggtcccattccaagatactcctgtggaagttgaacagaacacagagctacctgactacctgcctgaggatgagagtcccacaaaggaacaggacaaagcggtgtcccgggtcggctcacacc

SEQ ID NO: 10088 - DNA, 285 bp, Homo sapiens
tcactcctgcccctctcctccaggcaatcaaactttggtttctgtcactatagattcgtctgcattttggggatatgtagatatattctgaaatactgtatattctgaaaatacactatatgattctgaagtcatacagtatattctttttttggtctggcatcttttactcagcataattattttagattcatccagggtgtaccttattgatagttcattcattttattgctgagtagtagtccattgtacagatacactacaatctgttcatccattcatct

SEQ ID NO: 10089 - DNA, 619 bp, Homo sapiens
atttacaataagtttacaatttacaataaagctttaaaagaacaacaaaaaattaaatatacctctattgcttgtacgtttttctacttttgatagaaacatggacatattaaatatttcacttttaactctagtataagaaagtcaataatgcaagagtgatgataaagagcaactctcacttggcatcatgatcagggagcaatagggagtgggtgactgcggtgacctaaagcatacaagccttgtctaaagtgaacagctgctctcagccctagctcataagtgccacagagtctacaggcctagacctgctgatccccagcatttgcaagagactcttggtaaccaggattttaaagtaacatttcctggttaagggtagcggccgggcgtggtggctcacacctataatctcagcactttgggaggccgaagtgggcagataacttgaggtcaagagtttgagatcagcctggccaacatggtgaaaccctgtctctactaaaaatacaaaaattagccaggcattggtggtgcacacctgtattcccagctgcttgggaggctgacgcatgagaatcgcttgagccctggaggtggaggttgtggtgagccg

SEQ ID NO: 10090 - DNA, 591 bp, Homo sapiens
ttatatatgaaggatttcaaagagatgtcaattttggaaaatgcttctggccatcccaaatgcttggcttatatctactgttttttaacttgttttttttcctcattcattccaactcttattactaaaatactacatcaaaagaaattaagggaatctacaaatatatttgaataagtgattttgccatgtatactgaccagagtcacacttgctcttgctccaaaaacaaatcattgcactgcctgagaggaaaatggattgatggccaagaaagtctgattgttacttctctatacctcatgatttcctttctttttactgcagttctgaaatttggatggccaggtcattcagccctgatcagtcccagagcaaaacttacagtccctaagctcacaagaatgtaatgtgtatcaaaaggtaaatatagacctatgaaatgagatgattgctacagatgctgctaatattaatttcggccattctgtgcatttttttttctgtaaagaagtctattttggggccaggcgtggtggctcacccctgtaatcccagcagtttggcaggccgaggctggcagattacttg

SEQ ID NO: 10091 - DNA, 340 bp, Homo sapiens
gtagaagctatatgttgttattgtattgctatttatctacttaaataactcttactgtagtatgtattgctcaaggacagagattgtgttgctcatctttgtgttatcccacttagcatagtttctaagcaaatagtatagttctttcatatatgcttatcaagtaaatgaatttgactctacctcctaatgaactattcagaaattcatgtttacgattttagcaatgagaacaccaagacttagcaatagagtatcaaagataatacaactagggagtagatctaaaataagaaatctggtgtgttggctgggcatggtggctcacgcctgtaatccc

SEQ ID NO: 10092 - DNA, 433 bp, Homo sapiens
gacagaagggggaaatttgattattgataaatcatttgatattagtgagaaattgttaattaagagtgataatgacattatggttatgtaagaaagtgtccatattttagagatgctaatagaaggatgaagaaataaaatgatgtgacttttgtgtttgcttaagttactttggtaaagaaagaaataataaaaaaactaaatgaagcatatttgttgaagatcatttgaccatatacacaagagtttatttctgggctctattttattccattggtctatttgtctgttttcatgccagcactacactgttttgattactatggctttgtaatatgttttgaaatcaggaagtgtgagtcatttaactttgttctttcttttcaaaattgttttggctattaaagatcttttaatattccatatgaatttt

SEQ ID NO: 10093 - DNA, 572 bp, Homo sapiens
atccctggcagtcaagagactcttgagaaaaagcatctaagcaagtccttgaatgatgtggcatttcaataaaagagatggagaggaggcatttgagataggaggactagtaggagatggagaaacttggagcatattcagggaaaagcatcaagtccaactgagttagaactggtctatatacaggcatcaaaactggagaacattcagtgccaaatgatacagtcttgaatgccaactaggaattgtgaatgcattaaccaataggtgtcattaaaggtacttgaacaggggagtgttgtggctgtgcttcaggaccaggctcttgtgagtagcttggggggagatcgggaggagaggcagggcagaaactagaggccagaaagccagttaagctactacaacccaccaaggaaaaagaggggcagaaaaggcctgaaatggatgataacaatgaaatgggaaaggaatagatgcaaagggaagaactgacagaatctgatgtctcagtgaaggaacagctaaagctgacactgcgatttccagagcagtggtacccatggaggaaactc

SEQ ID NO: 10094 - DNA, 407 bp, Homo sapiens
gccaagtaggcaaccctgaaggagacttgggaggtggaagtgggcagtgaaaagcttcgagacgacattagctcttgtaagcacagtagcagaggtgacatttcaatttttagtcctgagcacctgtggcaggaggcagtagctgtggagttcccctaggagaatcccacgttctggctgaacatttctccagaatggctgcatcattcctgataaagtagaatgcaaacttacttccatgctcccccagaaattctgtaattgccagataccctgaaatcaatcttgttctgttcaaactactgtttaggatggattccattgtttgcaactcatagactaacctcatagggtttgggggaagattaggcatattagaatatgaatatatgtaacttgcatatact

SEQ ID NO: 10095 - DNA, 368 bp, Homo sapiens
agcagtatcatgcataaggccttcttggaacttcacaaagctattatattaatgtctttgaaaagttcttcaagaaagaaatatgtttaactttatttatcatcatttcccacacttgtttaaaccaccaaattcttctttcaaggagtagctatcaagttggttatgaaaatctgcttaaagttcaattaacagtattgttcagctgagcgcagtggctcacacctgtaatcccagcactttgggaggccaaagtgggtggatcacgaagtcaggagttcaagaccagcctggccaagatggtgaaaccctgtttctactaaaaataaaacaattagccgggcgtggtgtcgggcacctgtaatccc

SEQ ID NO: 10096 - DNA, 604 bp, Homo sapiens
tggcacgtgcctgtagtcccagctactcgggcggctgacacaggagaatcgcttgaacctgggaggcggaggtgcagtgagccaagattgcgccactgcattcaagcctaggtgacagagtgagactccgtctcaaaaaaaacaaaaacaaaaacctgatatagagccttatggtcatgatctattatatcctgtgtattgcacatgaaggaaaatattgtctttaataatattactgctggtttttaaaaaatcattaagtttcagaaagcttgctttctttacctcttactttctagctaagtagataattaatgtggttttatatttacctttaaaattctgtagttgtagagtcttctgccttgtgtttatacagagtttataaaaatttacagtgggccgggcgcggtgacttacgcctgtaatcccagcactttgggaggccgaggtgggtggatcacgaggtcaggagatcgagaccatcctggctaacatggtgaaaccctgtttctactaaaaatacaaaaataaattagccaggcgtggtggcaggtgcctgtagtcccagctacttgggaggctgaggcaggagaatggcgtg

SEQ ID NO: 10097 - DNA, 430 bp, Homo sapiens
gtgttcggacatcactgggcgttacctggagaggttacatggttagagcaggagtcagccaactatggctggtggccagccaaatttagcccactacctgtttttttatggcctgcaagctaagaatggttttcatgtttttaaatggttggggaaaaaaaatcaaaagaataacacttcgtgacacttacaaattatatgaaattcaaacttcagtatccataaatataaaattttattggaacacagtcacattcattcttttatgtatggctgtttttcctctacaattgcagagttgagtggttgtgacagaaactctacggccctgtgctatagtttgaatctcatgttgaaatctgattcccagcgttttcggtggggcctaatgggaggtatttggatcatgaatagactgatgccctccctg

SEQ ID NO: 10098 - DNA, 585 bp, Homo sapiens
tttgttgctgacacatgactaagtggtctaattttgaatgtagtttagaattcttgtatcttaaacatattattctatagccacaagtatttttgttttgcctactcaaatatgtacagatttgtaccaaacaatctcttcacacagatgagaaacaggtgaacattggaaaggtttcaaaatgttactggcaacttcaatttaatattaaagtgcagttcggctcagtggcttacgcctgtaatcccagcactttgggaggccaaggcaggcagatcacctgaggtaaggagttcaagaccagcctggccaacatggtgaaatcctgtctctactaaaaatacaaaaattagcctggtgtggtggcaggcacctgtaatcccagctagttgggaggctgaggtagaataattgcttgaacccgggaggcagaggttgtagtgagctgagagtgtgccactgcactccaccctaggtgacaaagtaagactgtgtatcaaataataataataataataatattaaaggtgtggtataaatttctagtctggccaggcgcagtggctcacacctgtaatcctagca

SEQ ID NO: 10099 - DNA, 613 bp, Homo sapiens
atgtgttgcctgcattatgccactttcactcataaactcagtatggtgctagctgatctacagagagaggaaggaatatacatatctctgctaagggaggagctcatacaccctacaatctaaattgattaagagcctggtaatttatatattgcaacattgaaaaagtcagttgcttctgcctccaaccaaagcagtagagaaatagctacaaagcatcaaccttgacatcaaagaagactaacacacttgctgtgggaagtctgtgaaatttgagggcacagacaagactaagggtattgcccttccaaccaaccacagcagttcagatttcctcaatgtagctgctgtttggttgagagaaaacaaagaggatagtaagtgaggcattggagctatcagcattcaaagccttttctacttaaaaatctttcccagttgggcacggtggctcatgcctgtaatcccagtactttgggaggccgaggtgggtggatcacgaggtcaggagattgagaccaccctggctaacatggtgaaaccccgtctctactaaaaatacaaaaaattagctgggcatggtggcgggtgcctgtagtctcagctactcggg

SEQ ID NO: 10100 - DNA, 400 bp, Homo sapiens
tttgcttcttggtctcatttcttatttttggtgctcatatttattttcctggagttcaacaactctaagtatcttcttcaaaaagggttccagagcagcaacattttaagatgttgtctttctgaaaagaacttcattttgccctcacaatcaatttaaaaattggccaggtttagaattttaggttctaaattatttttacctccaaaatttgaggcatagaatcactttttagtgtatactgattctgattttaaaaaaaatctgatggcaatctgatttacatttctggagatcccattcttgaagaattcctttgctttcatatctgctgacttctttattctggctcctttcactcttagggttgctactatgagtttagggggaaaaaggagac

SEQ ID NO: 10101 - DNA, 552 bp, Homo sapiens
ggaggatgcgtaagagaaatgggagggtgtgaagatgaagtaagattgatcacgagtaggccgagtgtgatggctcatgcctataatcccagaactttgggaggctgaggtgggaggataactcgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcaacagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacacca

SEQ ID NO: 10102 - DNA, 614 bp, Homo sapiens
  misc_feature 473: n = A,T,C or G
atcccagaacttaaaaaaagaaaacaaagaaaccctaatatagggctagtgagacggctgtgtgagcgtgagctggtgaggaagggcttggggccactgtgccagtgctgacggaatcctcgatagtattttgtcaagtcgaaggacagtaataatgataaatgtagcaatggttttctagacacgaggaaatggccttggtctttgggtggctactttgtttgtttgtttgagatgaagtctcgctctgtcacccaggctggagtgcagtgacatgatctcggctcactgcaacttctgcctcccaggttcaagcaattcttctgcctcagcctcccaagtagctggaactacaggtgtgcgccaccacgcctggctaatttttgtgtttttagtagagatgggttttcaccatattggccaggctggtcttgaactcctgacctcgtgatccatccgccttggcctcccanagtgctgggattacaggcgtgggccaccgcacccggcccttgggtggctactttcatagaaaggcagctatgctatattgatatggaacagaggcttatttattaaataaattcactttagcaataataaactcattacat

SEQ ID NO: 10103 - DNA, 246 bp, Homo sapiens
cctgcgagattattatctttagggtgagcacaccaaaaagatggccattgtccatgagctggaaagagagccctcaccagaacccagccatcctgcaccctgatcatggacttctagcctcgagaattgtgagaaaataaatctctgttatttgactacctgtgctatggcattttgttattgcagccccagcagactaagacacctagtgtccatggaccacacacacacacacacacacacaca

SEQ ID NO: 10104 - DNA, 625 bp, Homo sapiens
taattctttgttcttccccaaggaagggtgaggcaaaaactgacgctatttctactatcccaggaaaagagatggccaacctgccttttaggaaagaattaattgacatgcttatcctaagtcagttctatctccatctccttgctaaagacagctggtacaactggtagttaaggcagaggccatgagtgtttgcgaagggctgttgtgatttcttttgggcgggaatgcctccttaatgtggtaggaaagaatgacaaatgagccagctttggggtacatttagaattgctggcatcttgcttttgtaaatgtcaaattgaaacacatcaaaaatttcatatcaactctgttgatcaaattcttcctaaagctgggtgcagtggctcacgcctgtaatcccagcactttgagaggccaaggcgggtgaattgattgagtccaggagttcgaggccagcctgggcaacatgaagagagcctgtctctacaaaaaatacaaaaattagcttgggcacggtggcacgaacctatagtcccagctacttgggaggctgaggtgggagaattccttgagcccgggaggtcaaggctgcagtgaaccacgatcacaccactgtactcca

SEQ ID NO: 10105 - DNA, 441 bp, Homo sapiens
tcctcctttccatcgacatctgcaagcctggtcctgtctgtccccatcggggtctgcgaagcagattccctgacacggggcctcattccttctgcacccattgagcttgtgtgctgcctttgcacccggcctctccgtgagactggagctctgctaggacaggctgtgtcttaggcaaattggaacccaagctccattcccaccatatggctggcactaaagaaatcattcatgggccgggtgcagtggctcatgcctgtaatcccaacactttgggaggctgagacaggtggatcacttgagctcgggagttcgagaccatcctggtcaacatggcaaaaccttgtctctactaaaaatacaaaaattagccgggcatgatggcatgcacctgtagtcacagctactcgggaggctgaggcaggagaatcgtttgaaccc

SEQ ID NO: 10106 - DNA, 124 bp, Homo sapiens
ggtgttctagtaagtaatgaagaaacaaagaaattcctttgatcagggctatataaatttcctaaggctggtgtaacaaagtaccacaaacagactgacctacacaaaaggaacttatcatctc

SEQ ID NO: 10107 - DNA, 440 bp, Homo sapiens
gtatttccaaaagtaaaagaacagaataagaaaatggagccaataggccaggcacagtggctcacacctgtaatcccaggactttgggaggccaaggtgggcggatcacgaggtcaggatattgataccatcctggttaacacggtgaaaccccgtctctactaaaaatacaaaaaattacccaggcgtggtggcaggagcctgtagtcccagctactctggaggctgaggtaggaaaatggtgtgaaactgggaggtagagcttgcagtgagccgaggagccgagatggcgccactgcactccagcatgggcgacagcgtgagactccctctcaaaaaataaaaataaaaataaaaaaaagaaagaaaatggagccaatataaaagatatgtttcaagtaaacatccctgatataacatttgaagagttcaccatgtgc

SEQ ID NO: 10108 - DNA, 160 bp, Homo sapiens
gtttgaggctcaaagctcagggaagaccatcactagctcccagttcaccactaggctcagagaatgaggtacttgttatacctggccaggttaattgctccagaaactgctctgttacaaatgcttacaatatcttactgaagttcaaaagggaggtgga

SEQ ID NO: 10109 - DNA, 311 bp, Homo sapiens
aagggactctggtccaagtctcaaacacatccataaccctgggtttgctggctggggtttcatggcactgcctggcctctcccttccagtctggcttccctttttctgcggcccaccactcttcctgcatctgtcacactcgtctccatacacccctgctgagaccccttctctcctggcccaccagtcagaatggaagttctactggcctccaacttttgaattccaacctggcctttactcaagcccacgccggggagcttttcctgactaagaactccttgagcctaaccttataccgagaattccct

SEQ ID NO: 10110 - DNA, 461 bp, Homo sapiens
atgcaccaaacatgaagactcagtctgcttggtggaacccaactagccccaaagacccggtgcttgcctaacgtctggcaaagttacagctgagactgggaactcgaatttcattaatgttttctattaaaagcaccatttcccattagtatttggagggtaattgatctctagaagtgcatctcagggcagggctgaaggtgttaccacaaagggggaatgacttcataagtctcccactgagctgccacaaagccaaatgaaaatatctccagttccctggggaccagtaaggctattagattagagctcaggtgaagactatttgatgagtcagtcttcagaggaaaagccacggttgtaatagcattggcttgccaaagataaaacagcatttaaaaaccaggtaattttaaaagccccaaatcaaaggttgagatactttataaactttgaacagt

SEQ ID NO: 10111 - DNA, 508 bp, Homo sapiens
ttttattaatggtcatctttaaaatgtcaattaatgccaaagctctgcactgtgataatgcaaatctataaagaaactagcttgacactttatagtaagtagggcaaaaggaagaagcttttatgtttttattatacataactgaatatgacagaaggaaagaagaaggttggaaaccctaatgttttgagctgtgattgcaaacccaatttaaaaattaaaaataaataaataaaattctgaatttaaaccaacaggcttttctcttaggcctctacatttccacaatataatactggctaccatgggatgataaacaatttaaattactatggattgaatgctactgcaaatatgagtctttgtactacaaaaccaatattacctattttaataccactggtgaaagagaaatgccattgcatgaatgtctgctgcgcattatggagaaggctttagatcattaaattttcatccaccatcctttaaacttttttaaatgtttttc

SEQ ID NO: 10112 - DNA, 335 bp, Homo sapiens
cctgcctgactgatctgagggttaggaatgcttacaacaaagaagaaaccagaaatcaggaaaatgggaattgaaagccaatgttcacctccttacacagctcttaaggttggccctgccatcctaagctcaaggatctctacaggaagaatgagatatcatatgaaatgcacttcagaaattctattgagaagtattataattaaggagagttctctgagaggtagcatctttgaataggctcaaaacaggaaaataaactatttaatgcaagaattaagataacatagtggccaggcacggtggctcacacctgtaatcccagcactttggga

SEQ ID NO: 10113 - DNA, 601 bp, Homo sapiens
tgcaccaaacccttctggaggcggcgggctcctgggtagcaggggcctggggacaggaagacgccctctccagggtcacagcccaggtggatggggcctggcatgtggggcctaactctgccccctccccatggctcagccaccctcctggctgctccctgctgcccctgcctgtgaccccattgtgatgcccctcaactgtcctcacccagctggcggtgagccttgctcacttcctccctcacatccgtgatgcccaggcagtgcctgggacagagaaaagcctcaggacgtgctaactacacagagtctgtgtattaatatgaccataagccgggcgcggtggctcacacctgtaatcccagcactttgggaggccgaggcaggcggatcacgaggtcaggagattgagaccatcctggctaacgtgggtgaaaccccgtctctactaaaaatataaaaaattagccgggcgtggtggcaggtgcctgtagtcccagctacttgggaggctgaggcaggagaatggcgtgaacccggggaggcagagcttgcagcgagctgagatcgcgccactgcagtccggcctgggcgaaagatg

SEQ ID NO: 10114 - DNA, 68 bp, Homo sapiens
ctaactttcattttgccagggagtctgggggaaatacaattttcaatcttccaacacgtgtgatactg

SEQ ID NO: 10115 - DNA, 470 bp, Homo sapiens
tattgaattatagaaagcaaaagttacatttcttcagcactagtgtgactgggtagacaaagagtcatactatcaaaatatctaaaaaaagttttagggtaaaataaccaaaaaaatctttcaaaaccttttattcaatatttgcatttaaatttatgaatcactaagcttaacattttgtgttaatgaagttcgttgcaggcagtcagcacttattccacatgtgctgtggcctccacacaccctgcatttcatcagcttgtgcctagggatatttcctcttcaccttaacaaatactcatctaccataggccaggcattatataaaagtgaactgttaattacaaggaggggctgggcgtggtggctcatgcctgtaatcccagcactttaggaggacaaggtgggcagatcacgaggtcaggagatcaagaccatcctggctaatgtggtgaaaccctgtctctact

SEQ ID NO: 10116 - DNA, 431 bp, Homo sapiens
ggtagataaagtaaacacatagatttgtacatccatagggagaatgataaggaaatccgcctctcgataatcaaggtgatagaggagctagaaagaaatttaggcagatagagagggtaaaaggagtcctcagcaaggcttccttttaacaaaaagcagaaaccatttcttttctaacaaagagcagcctgtaaaattgagctgcaaacatagataagcaagctggaagctcgccctggtaaatgctggcagctgtgccaatagaacagggctacctggaagccaggtatgttcaacatggaggctcccttttgtcaccacgtatatagtgaagaaccaggcaacatgatgccagccaggtagggaacccatctgcataataaaagactagggtgggccgggtgcggtggctcacgcctgtaatcccagca

SEQ ID NO: 10117 - DNA, 454 bp, Homo sapiens
ttctcagtgttctttcctaccaccctccattcagatcaaatgcaaaagcagaaggaacagccatgttaacccttcatttcttctaagatccaaatgagggcttcatatgatcactgtctttagatacgctgggattcatacgtccatcacccaaaggacaagtctaactcagtgttctattccttttttggttcttttctttgcaagggaagtgaaaagtaggcaaatgttagtgagtgtcctgtagaaataactcaactgagatttaaccccattgcgcactccaaaatggctaaggtgcttaaaaatggctttcagcgtgaaaattctattcctgcatccttgttttcaccattaaagacaaaacactgctggccaggcgcggtggctcacgcctgtaatcccagcactttgggaggccgaggcgggtggatcacaaggtcaagagatcgag

SEQ ID NO: 10118 - DNA, 469 bp, Homo sapiens
tcactacgttgcccagtctgttcttgggcccgggagctggaggctgccgtgagccgagatcgccccatgccagtatgggcgacaaagcgagaccctgtctcaaacaaaactcacaaaatcaggggacaaggaaacaaaacaaggcttgatagtcaggcctagctgtggggacaaatgccataggtctgtggtttgcagcttcttggggtcctgagagaacaggcccctcccccttttcacgacagtgtgtgcatatgcacactcacttctgtatccagtttcagaggttctcagatctgaggtcccctatggactcctccgctacccccggttgcaaggtccctaagccattgaagaatctgacagaggcacaagtccaccctgacctttggcaggactgttctgctgccagagggattaccgagaaaggaaatcttgtcctggactcttcaagtggggtgagtgagct

SEQ ID NO: 10119 - DNA, 83 bp, Homo sapiens
gcagaggaacaggaagaagtgagcgtttgaggatggaatagtaagggcaggggcgacaggacctgctgatagattggagttga

SEQ ID NO: 10120 - DNA, 320 bp, Homo sapiens
agctggcctgggagatcacatggccagagactggcagggctggagggaaggggcaggcagggcgcctggtaaattacgccagcaggatcaagagttttccgggaatcaaagaatgtggaactcagtgagcttttccctggatttaatgggattctcagaatctgaaacctgcactttggacatgacgacttttatgctgtttgtagtttctataattatttcctttttgtttttccccaaattctttttgaaatggtcagcctaactcagctggaccttaaggacaaggaaaggaactggttcattcttaggcgaagatg

SEQ ID NO: 10121 - DNA, 575 bp, Homo sapiens
gtgtgcacctgtaatcccagctacttgggaggctgaggcagagaattgcttgaacccgggaggcggaggttgcagtgagtcaagatcacgccactgccctccagtctgggcaaaagagcgagactccatctcaaaaaagaaaagaaaatgggaatgcattcaggtgagtaaagtatttaatatgtttgtgttattatctgaaaactgcctgtggtgcctaggtccagggccaacaactcatgaatggatttgacagataaaatgttcagaatgtgataatacctaattaggaaagaaaatactagagctatgataattataatgtaacatcatgtctctctccaccccatctccaatggaaaaatgctgtcgttgacttaaatttccctgaagtgattttaaataacccagtgaaatttgagagagggaaatttgtttaaaatatgataaacaagatgaaagattttttttatcctaaaggttaaagtatcccctgaggtaaatcatctttgggaatagatgtttatattggttcctatgtctcccaaagacctccatgtcaaaccagcaatttt

SEQ ID NO: 10122 - DNA, 378 bp, Homo sapiens
cacacaataaaagcagggactgcaaccctaaaaaaaatagctgggagcaaatgggttatactattgaccaaaatcctggaaaaaggaatcaacacggggaagcatgaagcaggaatcagctcaaagaggcctggctcccaggagtggatgacggggtagccagtggcatggtctccagccagccccttcacctggggccagcttcctcatagcctgagatcttccaaagatcccagactatagttcaagaccagcctggccaacactgtgaaaccctgtctctactaaaaatacaaaaatttgctgcacatggtggtgcatgcctgtgatcccagctacttggggaggctgaggcaggagaatcacttgaacctggga

SEQ ID NO: 10123 - DNA, 635 bp, Homo sapiens
atgcatatttattaaaagtctctgaactccaaacctcttgccaatgtttcttaagcctgatgattcctactattgctccacaacgtgtatatgggagttcccatgtaggaagaaaaatagcatccttgtataactaattaagaaagattaaaggaaagcaaagaatttaactatctttacacagaaaaggtggccggtgttttagtgagtattttctcaaaatctatacccatgcctggcacatattaagcactaaataaatctgttagataaatgttcaaataattagcctaagcttatagacaagagtctaaaacattgatggcaaaattcccaaaatgcaaaataactcaagcaataggcattcaaaagtattgatttatattacagagtcaaaacaaggtggagagtatggattctagactccaggcttggattttggctctacttctttgacatcttgttataaccccctgagccaaagtcttctcacccgtacattaagaaaaataatattggccaggtgcagtggctcacgcctgcaatcccagcactttgagaggccgaggtgtgcggatcacgaggtcaggagatcgagaccatcctggctaacacagcgaaaccccatctctacg

SEQ ID NO: 10124 - DNA, 531 bp, Homo sapiens
tgggtggaaaacaggttaaacctgggagaaagagtcctcttttagggataaaaattgggattgttcagctggtgtggtgtgtttgcatggggtagcacaaagcccccgtgaacatgacttttaccactaactatctgtgtgaatttggcaagcgtctcgaacatcctggggctgtttactcatctgcaaaatggacacaaaaacacctgctctgcgatcttcacgggtggtggtcagagtcatgtgaaaagatgcaggcagtagagcgctgtgaaactctaaagtgctcagcaaatgtaaggtaggctgggtgccctggttcacacctttaatcccagcactttgggaagccgaggcgggcgaatcacttgaggtcaggagttccagatcagccaggccaacatggtaaaacccaatttccactaaaaatacaaaaattagccgggcgtgggggtgcgtgcctgtaatccctactcgggaggctgagtcaggagaattgcttgaacccgggaggcggaggttgcagtgagc

SEQ ID NO: 10125 - DNA, 351 bp, Homo sapiens
tagttaaaatggtaatgggaagaccatataaacaacagaaaattaaaagttcttaaacacatgaaaaggtgctgaacttcacaataagataaaaatgtacaaatatgagataatcatttttaactattcaattgacaaagattcaaaggtttgataaattattggctattttgcaggaaacaaactctccatgttggtataaatatagattaatataacctctactgaaaacaatttagcaaacttttgtttaaaatttaaatgtaggtcgggcacggtggctcatgcctgtaatcccagcactttgggaggccaaggcgagcagatcacaaggtcaggagttcaagatca

SEQ ID NO: 10126 - DNA, 649 bp, Homo sapiens
ttccctcgcttcattacactctcccttcccttataagcaccagtccaaaggctagaccactgaaaattctgtagctcccctgggtctggccacccctgtgcaactgtggcaatccgtgtgggcccgggggaatgtctgtggaagagggtggttcctgtaatgtggacagacagaggctgaggttccctgggcagaaaatgctcccctgaggcctgctcctgtagtatggcacccgcagccacagttctggtcctggggagggagagcaatggggagtgagttggtagtgtggtataaagacctcaaaaaatccccaaatcaccaacaacattagtgtttgggtccatgtgggcagagaaactctcttacagtttggataccagtggtctgccacagagccaagaggactcagatcattccaacctgccactttgatgaaatgtcaagtcgcggccgggcgcggtggctcacgcctgtaattccagcactttgggaggccgaggcgggcggatcacgaggtcaggagatcgagaccatcctggctaacacggtgaaaccccgtctctactaaaaatacaaacaattagccgggcgaggtggcgggcgcctgtagtcccagctactcgggaggctgagtcaggagaatggc

SEQ ID NO: 10127 - DNA, 509 bp, Homo sapiens
gtaattgaaacatacggtacctattaggacctatctgcacatatgtaactgctcatttcatctgtacaaatgactgcttacttaagcaaatggcaggtctgagtgctcatgttgggaaattttgctaggaagtcatttccttaggaaaggctatattcacatcctcaaagtgctgaaaagtctaggaaacacgatgccatggatgcataaaaagagggctggccaggatcggtagctcacacctgtaatcctagcactttgggaggccaaggcaggtggataacttgaggccaggagttcgagactagcctggccaacatggtgaaaccctatctctactaaaaatacaaaaattagctgggcatggtggtgcccacctataatcccagctacttgggaagttgaggcacgagaattgtttgaacctgggaggcgggaggcagaggttgcagtgagctgagattgcaccactgcactccagcctgggtgatagaggaagactctgtccc

SEQ ID NO: 10128 - DNA, 107 bp, Homo sapiens
aaccatatggaaggatgcttaatctcactagcaaagaaataaattccagttaaaaataagagatgtggctgggcatggtggctcatgcctgtgatcctggcactttg

SEQ ID NO: 10129 - DNA, 393 bp, Homo sapiens
ttctccatgttggtcaggttggtctcgaactcccgacctcaggtgatccatctgcctcagcctcccaaagtgctgggattacaggtgtgagccaccgcgcctggcctgattcttttgcttttcatgatatatcctgtgtaccttgagttttttaccaatgaacatgtattatttgcagagtaattttctaagccatatgaaaatgcatacagaaaaaaaattacactgccagattaatagtaggcctcaaaactatagaaataatttaaggagaaggagtaagaaatgtcatctgagattgtctttcaagataaaagacaaacataacagataaaaaataaatatatgtgtgtgcacgtaactattaaaacattataacaccccgggctcagt

SEQ ID NO: 10130 - DNA, 458 bp, Homo sapiens
atcaggagggctttgagcaggtgagagacgtgatctgactcaggtgttcacaggacccctctggttacatgtgagggacagactgcagggtgtgaggagggggacaggatgggagtgggaagaccagggagggacctgctgagacagcccaggaaggagaggatgggtaggggctgcagaatcgggcaggttctggatagattggaaggtggagctgacagcatttcacactggataatattctaagcagggaagagtcactcctaaacgtattcacacacctgtaatcccagcagtttgggaggccgaggcgggtggatcacctgagatcaggagttcgagaccagcctggccaacatgccgaaaccccatctgtactaaaaatacaaaaaattgaccagccatggtggtgcgcacctgtaatcccagctactccataggctgaggcaggagaatcg

SEQ ID NO: 10131 - DNA, 447 bp, Homo sapiens
tacaaaaaaaaaggaaatggaaatattaaaaaccaaaccaagacttcaatgtgaagtcttcagttactcaccaattgctaatgcaattgtgtctagttttgagattagggatcagactgtgcctgtgtccatcctacagaaaaatcatctatttttttccacactgaaatttaagagaacttactgaagttaacatattccattctgggaagtgaattataatgtgtaattattacaattaccacaactggaatgtaacagggttatttttcagagaacagaatttgtcagaaggagaaggaagaaaaagagattatgaatgattaaataaatttctattggatatacaaaaagtcaaaacttttcaatacatacagcttagcttctagaataactatttactgttgagactctctttccaaagttatttgtgctactccttcttct

SEQ ID NO: 10132 - DNA, 564 bp, Homo sapiens
ttgtgatccgcctgcctcagcctctcaaagtgcttgtgaactaccgcgcccggcccctaattactgcttttgaatgttaactttaagtgaaaaatcttttagcaatgttttgttatgtaaggatattttcatattcagtgactatgtcatcgaaacacatgaattacttataggggtaccagcagttgctgaatattaaatgtaggttacttgttctttcagcttctacattcagagttccttaatttgtcgtcaatgaaccacctgaataaaaaaacgtaaatatgtgacaatgaaggtccacgaaagctaggtgcaagattacatgatccgattcttcacaacacacagctaaatgaaaatacagctactctatgaacctcaaagatctttgatgacactgcaaatgacacaaaagcaacctaagctgtatgcttttttagcatctactatttaggagggccaccttataaaatagatttgaatctcaataaaagtctactgtatccgcaggaaaatcctaataccattcactcacacaaataatttaactatccatttcga

SEQ ID NO: 10133 - DNA, 82 bp, Homo sapiens
aagtgaagagaactatttcaagtaagcgtatggaactgaaatattttaatcataacaaataagctttaattggctttccctg

SEQ ID NO: 10134 - DNA, 461 bp, Homo sapiens
  misc_feature 310: n = A,T,C or G
tcttaaaacacattcctacataaaaaaacgaattccttctgtaaaacgacctcagtcgaaagcataataattggtataaattcttactcttttaaaataaagattaaattccagctaaaaattctccagatatggcagtatattgctctttgaattgaattgaggaagggcgagggtgagagacataaaagactaaaacagcaaaaggaagaaaaaaagggaaggaaaaaggtaaaaagaaaaagaggaatataggtcggacacagtggctcacacctgtaatcccagaactttgggaggccgaggcggngggatcacttgaggtcaagagttcgagaccagcctggccaacatggtgaaaccctgtctccactaaacatacaaaaattagccaggcatggtggcaggcacctgtattcccagctacttggaagactgagacagaagaatcactcaaaccc

SEQ ID NO: 10135 - DNA, 372 bp, Homo sapiens
ggcacgaggaacagtctaaggtttgtaggacttgcgttccacctaccaaagctaatcgagttagaaggctccaaactgaggtgtcatttctcattacggtggtgagaggacgggaccacacactgtgaagtcttcgttcccacatcccacacttcattcttgccgcctaagttgtcgccgtgggactattgaaagggtatcagcgatattcatctttcctataaatgggatctgctttctacagtttcctgccagatgtgtaaagattgcaagaattgaaggtatttcttcaactgaagacctttacagatactcagatgactgaaatcctcttatcactggctggacatggtggctcacgcctgtaatccc

SEQ ID NO: 10136 - DNA, 577 bp, Homo sapiens
ggcacgaggggaagtgccaggaagaggagggtggccatgcctggccatttcctgatacctgtgctagtgacggccgcggtgtgtccactggaaagaaacactggcgtgcacggctgtgactgtggtttcagcagttctgagacaagagccttccaagtcgggggctggggagcagagtgcgggagctcctgagtcctgggggcctccgcgcctcacagcatgggcacatgtgggacagaaggcctaatggggtgcctgagggtggcctggttgctgtccccccagggtgggaccatgagcgagtaggggtggcacacgggctcagctctctgtggccggggtggctcctcttgcgggactcaacgtcagccccaaggcgatgttcagggggtccctcagccttttgaggtggtgccgtttagggccgccatgcctgtctatccaggggacggactccgcctgctgttcccgcgctgagctacaggactcccgagtgtgagccgcggttcctctgttgcagcgcagccgtgtgtgctgtggagccgaggccgtcctgcaggaagccgcgtgactcccg

SEQ ID NO: 10137 - DNA, 291 bp, Homo sapiens
ggcacgaggggaggtcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatcctcatatttcttttaccaaaaaaaaaatgaattaagtaattttgaaaaagtctttctgaaaactgcttcaggtatgtttttcagtacagttggatgtcatccta

SEQ ID NO: 10138 - DNA, 62 bp, Homo sapiens
gtctcgaaaaaaaaaacaccaggctggcttacaaaggatggtgtttttttactgtcgtttcc

SEQ ID NO: 10139 - DNA, 651 bp, Homo sapiens
gaacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttatttt

SEQ ID NO: 10140 - DNA, 625 bp, Homo sapiens
ggcacgagccacggtgagcaggctagaaactcacgacaccaggtagctctgcaggtgctgggagggcaactcagcccagaggaagagcaggctggggagccctcaccgcccaatggggactgacccctggcccctgcccctctccaccccactgccctgaagccagatttcctgctcagcatggacaggacagcaagaggctaaccctctgcccaggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctgg

SEQ ID NO: 10141 - DNA, 606 bp, Homo sapiens
ggcacgagggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactggggtgcgtcttggaacttttcctacacct

SEQ ID NO: 10142 - DNA, 585 bp, Homo sapiens
ggcacgaggccgcggcttatggtgcagacatggccaagtccaagaaccacaccacacacaaccagtcccgaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgca

SEQ ID NO: 10143 - DNA, 593 bp, Homo sapiens
atgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccgcaccaccaaaaccacaatcccacaaccaaaaatgtctgcagacattgtcaagtgtctcctggttagggaaaaggag

SEQ ID NO: 10144 - DNA, 603 bp, Homo sapiens
attttcagctgttacagttttacagtttttagaggtaggtaagttggcttctgccagtcattcctgtacctaagtacatctacagactgtatggtaacagtgtatcatttggggaagaacattcttttctcctcccccaccccacaaaagaaaaacaacagcacatttattttctacttcaaattagcagttgctactgccctgggaggcttccctaagagttgttgctgaagattcaattaaaaacacacctgctttcgactgttgtctgctaaatgggaggagagaagtccgtatctcttctatggcttgctctgataggcctcatagccctccctttttcttgtctcctgaccagggcttataaggagttggcttagaaagacagcagagtctgtaatctcagcagtttgagaggccgaagtgggcggatcatgaggtcaggagatcgagaccatcctggctaacatggtgaaaccctgtttctactaaaaatccaaaaaattagctgggcgtggtggcacacgcctgtaatcccagctactcgggaggctgaggcaggagaatcacttgaacccgggaggcggaggttgcgttgagctg

SEQ ID NO: 10145 - DNA, 585 bp, Homo sapiens
aactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcat

SEQ ID NO: 10146 - DNA, 589 bp, Homo sapiens
ggggaaggagggacgtcccaaggaagggtctttgagaaaggggtaggggacgacatcaggagaaggctcccaggaactgtctcaggggagcgaaggttttgaggggacagctggggtctccagtagatagaccacggtgcaggctgagggatgtacttcttggcacaaggcctcggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatca

SEQ ID NO: 10147 - DNA, 582 bp, Homo sapiens
ggcacgagggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgc

SEQ ID NO: 10148 - DNA, 206 bp, Homo sapiens
acgacagaagggtacggctgcgagaagacgacagaagggtacggctgcgagaagacgacagaagggtacggctgcgagaagacgacagaagtgtacggctgcgagaagacgacagatgggtacggctgcgagaagacgacagatggtgcaacatgctgaaccccggctctactgttaagatacaaaatgagctggtgtgttgcact

SEQ ID NO: 10149 - DNA, 518 bp, Homo sapiens
gacagaaggggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccgactttctgagtaagggaggagcactttttttccaaaaaggaaagaacgtctctactgggttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagtactgtgtgcatttttgtgtccattgtttaaatgtaatgatattggacaaaaaatttacagcaaaattaagtcagttctgctgaaactggattttggaattggagaatatatta

SEQ ID NO: 10150 - DNA, 338 bp, Homo sapiens
  misc_feature 130, 187, 237, 258, 300: n = A,T,C or G
caggcacctgctaccatgcccagctaatttttgtatttttagtagagacatggtttcaccatgttgcccaggctggtctccaactcctgacctcaagtgagccacccccctcggcctcccaaagtgctgngattacaggtgtgagccaccacacccagccaaaaatcaccttttttacaaggatcanaacagtcattatgctggagatgacagacctcactgtcaccatgctctttntgatgtctactaagcacggtngctggtccacactcacagaaaccttagaactcgcacccaggngctcggctgtagcagaatcccaagaataaaacctgtgc

SEQ ID NO: 10151 - DNA, 103 bp, Homo sapiens
ataaaaccctcattcacacgagaaaacaccctcatgttcatacacctatcccccattctcctcctatccctcaaccccgacatcattaccgggttttcctctt

SEQ ID NO: 10152 - DNA, 582 bp, Homo sapiens
taggtctaagaacaggtcaatggtggtttaacccagtggtggttgggttaaaggagtggggcaggtaaggaggttgtggacaaaatgaggaacttgaaagtttaaaatcctgaaactaatcaattttgttggccatctcatagggagccaaaagtcacaaaatcaggtatgtgtggtggtgcatgcctgtaatcccggctacttgggaggctgaggcaggaggatcgcttgagcccaggagtttgaggctgcagtgagctatgaccactgtgaatagctactgcactccagcctgggcaacacagtgagaccccatttcgaaaacaaacaacaacaacaaatcatgagaccagagttaagaaacaatgagaccaggctgggtgtggtggctcatgcctgtaatcccagcactttgggaggccaagatgggctgatcacttgaggtcaggagtttaagaccagcttggccaacatgacgaaaccctgtctctactaaacatacaaaaattaggtgggcatggtggcacgtgccttgtatcccagctacttgggaggctgaggcatgagaatcacttgaatccg

SEQ ID NO: 10153 - DNA, 591 bp, Homo sapiens
ggcacgagcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgtttcctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactg

SEQ ID NO: 10154 - DNA, 552 bp, Homo sapiens
ggcacgagattttggagacgacatggtgagaggctagctctagggatggtttagaaaataaagtcacctggggactggtccacccccttccggtccccttgcctgttggggtcagggctgccctgggaagggcagcgacgctgggttggtaggagcatagactgcagggcatctgcctgagtgtagagtccctgggcctctaattctgtaaaatcgcggtaatagcatccgcttctctgagctgttagaggtgtaacaggtaaacccatgtaaggtgcttaggacagggctggtgctggctaagtgccgttaatatcgtcagcatcattacctgcgttattgtagcactgatcgccatgtcagctgccttcagggtctggcaggtaaagtagaggggccaggtagagatcctgctgacctggcaagcacatgttccctccagtcggggcgttgaccgctcagcagcaggtctagtgtcacccagtctttctagttctcaggagaagttgagggtctggatttttagaggatagctcttgtttcctttacttt

SEQ ID NO: 10155 - DNA, 572 bp, Homo sapiens
ttatacaagtggcaagaagaggacagtggaccagctcctgggaccttccaaaacattggctttgacatctgccaagatgatgattccatccacctggagtccatctatagtaatttccagccctccttgagacacatagaccctgaaacaaagatccgaattcagaggcctcaggtaatgacgacatcattttaaggcatggagctgagaagtctgggagtgaggagatcccagtccggctaaacttggtggagcattttcccattgagagccttccatgggaactcaatgttcccattgtaagtacaggaaacaagccctgtacttaccaaggagaaagaggagagacagcagtgctgggagattctcaaatagaaacccgtggacgctccaatgggcttgtcatgatatcaggctaggctttcctgctcatttttcaaagacgctccagatttgagggtactctgactgcaacatctttcaccccattgatcgccaggattgatttggttgatctggctgagcaggcgggtgtccccgtcctccctcactgccccatatgtgtccctcct

SEQ ID NO: 10156 - DNA, 588 bp, Homo sapiens
ggcacgagcaaagatttattcaattaaacttgaaatgcatctggattcttaaaggttcagtagtgatcactgggacagggcgatcataaaactgaatgggctgtcggaaggtgtcgaggcagcagcaagggtgacattgccactgacgggggcttccgaactggggacgtttgtcattgggatgtgttacaagttcgggctgtggaaattactcgatgaaaaacgcacattaacgatagccatgaaatattagttaagggaaactaggttgagaaatgagacagcaggatctatcagagcctggcattgttcgccacagcccaggtagtgattaaaacgactgtcaagcggcagtgggtgggagctgaggagcacggggctgtgagtgacgaggccgcgtccggggctcacatcttggcactgactccccaggacaacttggttccccacccaatgcctccttccagggctgctatggggttcaaatgagataatgtctgtggaacacttggctcagggcactgcacatagcaagcccttccacagtgcgggctggtgtcactgtgactgtgggcttctctctgacac

SEQ ID NO: 10157 - DNA, 404 bp, Homo sapiens
ggcacgaggatgaccccaacgatccatactaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcaaaacaagcagaagaaacagctcccattgaggccactgcaaccaaagaagaggagggatcaagttaatgaaggccacaaggcactgggcaccagtccttttggagtggaccttttgcaaaaggg

SEQ ID NO: 10158 - DNA, 449 bp, Homo sapiens
ggcacgaggagctttgtcaaaatacctggcctctagttctgagattttattattgttcattagaccagtgctagggcatgaatgttttgtgtttatcttttttttttttaaactttaattttaggtttagggatacccataaaggtttgttccttaggtaaacatgtgtcacagggatttgtggaacatattatttcatcacccaggggggaaccccagacctcaatagttattttttctgctccttttccttttcccaccctcccctttaaaataaactccaaggtctatggttcccttttttgggtccataagttcttatcattacctcccacttataagtgaaaacatgcggaagtggattttctgtttctgcattagttggctaaggataagggcctccacctccaatgttttgtttttaaaaccctccaagtgactcctggttt

SEQ ID NO: 10159 - DNA, 111 bp, Homo sapiens
gctcctggtggataaaacagggaagaacatcatctgggttctttgcgcagtagcagccactcttgtgtcccacatgatgctggcctttacgatgtggaacccttggattgc

SEQ ID NO: 10160 - DNA, 391 bp, Homo sapiens
ctgattctattggaaaagatcatgaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagaga

SEQ ID NO: 10161 - DNA, 581 bp, Homo sapiens
cattttggtttacacagtctgaccactagcacaatgcctggcacatagtttacaaatcatttaaggcaagcttaccatcttaagacaatttaatacatagaagtgtccctcctaaaaatctgagtttgatttagaaatccagttatacctgcaggtactgatgactaattccttctttgaagacaaaataagcagctgtgtagcttcagtggctctcaaatggataatagattcagtgtatactcgctttgaactttcctgttttttgatcagctagataaatgactttagtgggtaaatgtctgcctccaaaaccaaattctgaccctgatctaagtattctactgcaccgctgtcactggaatatcaaagttggccttcagactggtgcctggttccttggattggcttgagtattgaggtctgtctcatcttactagggaactaaaatgatgttgattgttttgtagagaattgtaattagagatctgtaggttcttaattcttttggaattccattctgaaaattttcaaccttatggtgttggtggagtgctcatgtgaagagtgaaactgactta

SEQ ID NO: 10162 - DNA, 94 bp, Homo sapiens
acaggacagcaagactcgcagactggacatccgggcaccactgcaccctgagaaggtgtgcaacaccatctagcagccacctgcctgctcctat

SEQ ID NO: 10163 - DNA, 594 bp, Homo sapiens
ccaaggactaggagtgtgagaaaaattgatcctcaggaggaagactgcaatgcatttagcaggaaagagtaatgtttcttaagaaaaaaatgaaacaatgaaaatccactaaaatctgtctcaaggataatattccatgactctacagggcttaatgcgtgtgacatatatagacttctgataagcagtttgaattatatgggtcagagaaatttccaggtcataggacttctctttaaagtaaaataaataggccaggcacggtggcttattcccgtaatctcagcactttgggaggccaaggcaggtggatcacttgaggtcaggagtttgagaccagcatggccaacatggtgaaaccccgtctctacaaaaatactaaaataaggccaagaagggtggctcatgcccataatcccagcattttgggaggccaaggcgggcagatcacttgaagtcaggagtttcagaccagcatggccaacatgatgaaaccccgtctctactaaaaatataaaaattagctgggcatggtggtgggcacctgtaatcccaactactctggaggctgaggcaggagaatcacttgaacct

SEQ ID NO: 10164 - DNA, 490 bp, Homo sapiens
atcaactttcttagttcaggccacctgcaacctccttctagtagcaatcacacccccagcagcctggaactagagtattctgccaaagcagaaaccctgtcactctactcacctatataatgattttctgtgaacttaggtatgaagttgaaaatcctcaacttgtcatacaaggctctttatgttgctcctgctttagtggccaccaatctaccaccccattcactctcccactcccaaccctacacatgcacaccctcttcacattcaatttcttctcctttctccctctccgctcagcaatactacattactttcaactttgcagaagtttcatgttgctgtgtctgcaaatcttctgtacatacatgctttttatatatcctggaatcctctccccctaattcccacctgctgcatctctacctgctaagtccttcttatcttttaggtgtcagtgtagtctttactttttgggtctcttgtatgc

SEQ ID NO: 10165 - DNA, 401 bp, Homo sapiens
attgaataataaaaatttaacccattgttgtgaaggagcctcagaatattttgatgttaacaaaagagttctgtatttacaaagttggagaaacactcatcaagagttaggagtaaggcccagtgtggggttccctctggtaataccagcattttgggaggctgaggtgggcgaatcacttgaggtcaggagtttgagaccagcctggccaacatagcgaagccccatctctactaaaaatacaaaaattagccagctgttgtggtacgcacctgtaatcccagctacttgggaggctaagggaggagaagtgcttggacctgggaggtgaaggttgcagtgagctgagaacacgccactgtaccccagcctgggtgactgagtgacactctgtctcaatt

SEQ ID NO: 10166 - DNA, 511 bp, Homo sapiens
cttaactgtatgaccttggacatgtcactagacttgctttagtgtctccatctgtaaaatggggataaagatggactcttctctcccaaatgcccagcatgatgtgcagggcctgtccccccaggagaacctgtctcaccatccttccccacttcctcccacccccaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcggagagtgatg

SEQ ID NO: 10167 - DNA, 505 bp, Homo sapiens
cgctgtagtgtttaattgttaaagccatatgtgtttcaagggaaattgaatccatatgtttctgattcatttgcactgagctcatcaaattgttgttttataagagccgtttgctgtccaggaagaattccccagtgcccctccccacaccgttctatgctgtctaatatctttaaaacaggactctgttctctgcccagcaaaaccctctatcactaccgtactactgcaatcaccttctccactgtaacgttttacatgataaaagttagcctcttttcatggagtaagacaagacggtatcttacagaaaagccgcctaagtgtctcccatgaaaactgcagagtgaagattgagttaaacaaagttaagcaagtctcttcgttgatatctcaagactttacatttcaaaaaagtgaaggagccagacatagtggctcacgcctgtaatcccagcactttgggaggccgaggcgggtggatcacttgaggtcaggagttcta

SEQ ID NO: 10168 - DNA, 442 bp, Homo sapiens
atttgatccctactgactgccctgtgccaggcactgtggtaggccgcgggaatacagcagacaaaaacccctgccatgccaaagagggagccagaaaaacccacagtgagtaagtgaatcgatacgtaacacgttccatgcaaaatacactaggagaaaagtagagcagggaggggatgtctttggggggtgcagtttttaacagacgaggtgacactgaaaaaggcctaaaggtcccggcgcagtggctcacgcttgtaatcccagcactttgggaggccgaggtgggcggatcacctgaggtcaggagttcgagactaacctggccaacatggtgaaaccttgtctctactaaaaatacaaaaaattagccgcgcatgtggtggcgggcgcctgtaatcccagctactcgggaggctgaggcaggagaatcgcttgaacc

SEQ ID NO: 10169 - DNA, 296 bp, Homo sapiens
tataacaggaactcaaagacaatgcacagggctataatctaagaacagatgtattaacagccttactcactgtaaggctgggaacccttgaagccaggcattatatgcacattctcaaatatgatgctctagttaaagccttggtaatatatataaccaatgtttccaactgcatcctgttataaagagagagcaaattttattaaacttatgtaaataattcttgccataaaaaataagaatactcatggatagtttctgaattttagaggaatcaaatagggacaaaaaaaaat

SEQ ID NO: 10170 - DNA, 259 bp, Homo sapiens
gaagctcttgttaaaacaggtgcgcctgaggaactgcgtttatgcgtgaagaacactctccatttgcccctgacgtctgcctcactcttcccagattgaacctttattatcccatgctgggctgggacctcattatggaaggcctcgaaagccagcctgcggaggttgaacaagggagtaggatgatgagagttctgctgtaagagattaacccagcatcagtgtaagagacttgagagggaggaatgggtagagaaag

SEQ ID NO: 10171 - DNA, 506 bp, Homo sapiens
catgtgctgccacaggaagtgcaaactagaatgaagtctccgaagagaagtttgtcagttcatttccagagccttgaagacattcatattttctgacttaacaactccatttgtaaaaatttctcatgagaacacatcagataggcactcgagattattcactgctgtgctatttaaaaaagaattttaaaactgtcatgcaaataaatgcccaatgatagggggatgactaaataaaattaagaatatgcataaaagacaaattgttgactgggtgcggtggctcacgcctgtaatcccagcacttcgggaggccgaggcgggcggatcacaaggtcaggagatcgagaccatcctggctaacacagtgaaaccccgtctctactaaaaatacaaaaaattagccgggcgaggtggctggagcctgtagtcccagctactcgggaggctgaggcaggagaatggcatgaacccgggaggcggagcttgcagtgagccgagatagt

SEQ ID NO: 10172 - DNA, 513 bp, Homo sapiens
tgcggctgcgatcatgccacggcactctagcctgcatgatagagcgagatcctgtttatgaagaaaaagagactgggcacggtggctcacgcctgtaatcccagcactctgggaggccgaggtgggcggatcacgaggtcaagagatcgagaccatcctggccaacgtggtgaaaccctgtctctactgaaaatagaaaaattagctgggtatggtcgcgcacacctgtagtcccagctacttgggaggctgaggcaggagaatcacttgaacccaggagacggaggttgcagtgagctgagatggtgccactgcactccatccagcctggtgacagagcgaggctccctctaaaagaaaaacaaaaaaagaaaaggaaatgaaggaaatgaaggctgggcatggtagctcatgcctgtaatcccagcactttgggaggccgaggccagtggatcacttgaggccaggaatttgagaccagcctagccaacatggtgaaaccccgtctctact

SEQ ID NO: 10173 - DNA, 468 bp, Homo sapiens
cttcttcttttgacctgtcacatgatcagggtggaggaagaattaactgacctgacctaggaggattttctattcatttaaattcatagagttcgtgtcctttgccaaacaaatgtgcataacaagtaaagtatagaatgggtcagagaagccatctggtctcaccttctaaatttaccaatgagaaaattgaggcccacagagattgaaatcctctcctgagtaaaatagtcagaatcaaaaatgaaatctaatgattcccagatggttgtttcttccactataacatcatattattctcctgcattatcatttaactttctgtttacctgtctcatcttgccaactagattgtctttagtttcattccaaaactatctaaacggcatcctccatttccaggtggcagtaaaagattaaaaagtacctcctggccaggcacagtggctcacgcctgtaatcccaaca

SEQ ID NO: 10174 - DNA, 554 bp, Homo sapiens
cgatttggatgtgtgactatgtgatgtaaaatttctcctacatttatattagtaagtcattgttatttgtaagcatgacaataatcactttattaaatatatagtattattaagcaggattctgcctgtattttatgtaaaatacgaataagttttgaaagacaactatgaaaacatatttatactaatttatgtactgatgtgtatttggtcctttcgtttataaaaaattaaacaatctttaaactgtggacttttcatttggttctggtttgagtttgtgtcctgtcacatagatggtaggttaagtacatggtagaaaagttcatttttagaaatctgaaaatcaggccaggcacagtagcttatgcctgcaatcccagcactttgggaggttgagtagggcagatcacgaggtcaggagatcgagaccagccatgaccaaaatggcacaaccccgtgtctattaaaaatacaaaaattagctgggcgtggtggcacacacctgtaatcccagctactcgggaggctgagacaggagaatcgcttgaacc

SEQ ID NO: 10175 - DNA, 531 bp, Homo sapiens
tggggattgggttaacgtatataaaatattagatggtggtaagaagtgctaataagtgtttgttaaatatataagcccagggtcagcctggcttcctcctcatcctcctcctgctcacctggcctggaccccaacctctcccctagcactgagctcactgcccaggtcccacagcagcactccaggcctggactatttctacagccatctctctgcacctgtctttgtccgttgctgcagctacaacaaaatatcataaattgggtgctctggccaggcgcggtggctcacgcctgtaatcccagcactttgggaggctgaggggggcagatcatgaggtcaggagattgagaccatcctggctaacactgtgaaaccccgtctctactgaaaacacaaaaacaaaattagccgggcgtggtggtgggcgcctgtagtcccagctactggggaggctgaggcaggggaatagcatgaacccgggaggtggagcttgcagtgagccgagatcgtgctgctgcactccaccct

SEQ ID NO: 10176 - DNA, 599 bp, Homo sapiens
caattatagcaagtagactttttgtgtgtttcagaaaaaggcacataatttaatgaatggtagatattattatgtgattagatctttttttctttaagaaaagctcattaaatacaaagctgcttagttatatcaacattgacacataaaatttttatcacttacataacactagaatataatgaaccagtgaaatttgttcgttctgtactttcttattaattgtttcctgattagttactttatggttgaggaaaaaaaggaaaattcttgcactgacatatgtaacttgtttaaaaggtgaaagttacttgaattttaaattaattgtagtaactcatatgaactctaaattctttataggaatccaatttgtgaagacagaaattattagaaaagtaatttttttaagaaaagtattgtttaggtccgggcacggtggctcatgcctgtaatcccagcactttgggaggccaaggcgggcggatcatgaggtcaggagatcgagaccatcctggctaacacggtgaaacccggtctctactaaaaatacaaaaaattagccgggtgtggtggtgggcgcctgtagtcccaggtac

SEQ ID NO: 10177 - DNA, 528 bp, Homo sapiens
cttatcaacttagtcaatggcaataatcataaagtaaacattaaggaaaatattttaattacaatactaccaatattatatacaccaaatttccttagcaacagtggttacagaagtaaacaatcacgagcaaaagcaaaatttacggctattgaaatcattaacaagggccgagcacggtagctcatgcctgtaatcccagcactttgggaggctgaggcaggcagatcacgaggtcaagagatcaagaccatcctggccaacatggtgaaacccggtctctactaaaaatacaaaaaaattggctgggcatggtggcgtgcgtctgtagtcccagctactcgggaggctgaggcaggagaactgcttgaacccgggaggcggaggttgcagtgagccgagatcatgccattgcactccagcctgggcaacaacagcaaaactccatcttgaaaaataaataaaataaaataaaaataaaaataaaaataaaaatggagatggctggacgcagtggctcacacctgt

SEQ ID NO: 10178 - DNA, 175 bp, Homo sapiens
gtaatgttttcttaagcatgacacctaatacacacacacgcgaaaacaaaacaaaacaaaacaaaaaacaaaaaaacaaacaggggaaaagtaggtaaattggacttcctcaaaattttaaaatgtgcttcaaagggcactatcaatacacaaagaactattgcataaaactgaa

SEQ ID NO: 10179 - DNA, 573 bp, Homo sapiens
tggagaacccttgggggttacatttcaatatggggcaattattggtggctacaagtaggttcgtgcaattattggtggtaggatttgagctggcctgaaccacaatattcagacactaccccttctgtctgcccctctcactatcccaagggagaagggattccaaaatctcaacacttcactttcctgtattaagctgtgaatgcaaacaattgttctagtcattcaatgtcttctgaggaaaaacaattcagtgcagaatctaacatacaccatgtctatcatgtaaaatttatgccacagaaaattagtatgtgctgagaataaaaaacctaacttttattatttctcttttttcctttatgacctgggcaatataatttgatgaatcaaaatttggccaggcacagtggcttatgcctgtaatcccagcactttgggaggccaagtgctgacagatcacttgaggtcaggagttcaagaccagcctggccaacatggtgaaaccctttctctgctaaaaatacaaaaattaaccaggcgtggtggtaggtgcctgtaatcccagctact

SEQ ID NO: 10180 - DNA, 516 bp, Homo sapiens
gatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattatgaccccctatataaggaggcgctgcaaatgctgcgggatgctggggcccaagtctccatcatgacctacgatgagtttgagtactgctgggacacctttgtgtaccgccagggatgtcccttccagccctgggatggac

SEQ ID NO: 10181 - DNA, 653 bp, Homo sapiens
tggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttcttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgaaaaaaaacaaaaaaaaacttcgagcctctagaactatagtgagtcgtattacgtagatccagacatgataagatacatt

SEQ ID NO: 10182 - DNA, 162 bp, Homo sapiens
ggcacgagccccggtcgtgtagcggtggtatactacggtcaatgctctgaaatctgtggagcaaaccacagtttcatgcccatcgtcctagaattaattcccctaaaaatctttgaaatagggcccgtatttaccctatagcaccccctctagagccaatac

SEQ ID NO: 10183 - DNA, 638 bp, Homo sapiens
ggcacgagagttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctctctgaagtcttctacctggaggcttcatctgcatgataaaactttggtctccacaacctcttacaacccaggcattcctttctatcgataattactctttcaaccaattgccaatcagaaaattgttatatctacctataatctagaagcccccacatcaagttgttttgcctttctggacaggaccaatgtatatcttaaatgtatttgattgatctctcatgtctccctaaaatgtataaaaccacgctgttccccgaccacctggagcacatgttctcagggtctcctgagggctgtgtcacaggccatgttcacttacatttggctc

SEQ ID NO: 10184 - DNA, 539 bp, Homo sapiens
ggcacgagaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcaataggcccattcctccacatcctacagagcaacctgctgaaagccatggactctgccactgcccccgacaagatcagaaagctgtatctctatgcagctcatgatgtgaccttcataccgctcttaatgaccctggggatttttgaccacaaatggccaccgtttgctgttgacctgaccatggaactttaccagcacctggaatctaaggagtggtttgtgcaactctattaccacgggaagg

SEQ ID NO: 10185 - DNA, 597 bp, Homo sapiens
acagagtctcagtgtgttgcccaggctggtctccaactcctggcttcaggtgatcctcttgtctcagcctcccaaagtattgagattacagatgtgagccactgcgcctggcctatagcagttatttataaccttgtattatatatgtaaaaatatttgttcctactttgtcattgagtcattaattcattcttgagacagggtctcgctttgtcacacaggctggagtgcagtggcaataacagctcactgcagcctcggcctcccaggctcaagcgatcctcctgcctcatcccctccccaaaccccagtagctgggaccacaaatcatgctactttgtcctttatcttttaactctgcttatgatattttttggccatacaaagttgtttaatttttaccttatcatttatccatcttttatgttatagttcaggttttgttatgcatagaaaaccctttcaaattcagtgattagtggccgggcacagtggctcacgcctgtaatcccagcactttgggaggccgaggcgggcaaatcacgaggtcaggagtttgagaccagcctggccaacatagtgaaaccctgtctctac

SEQ ID NO: 10186 - DNA, 586 bp, Homo sapiens
tacaggaagtgcctgtgccttgtgggaaaggaactgaccctcgggtcctggaggacaggaaatagaatggctgagtgggcctgggaatattatatgatggaaaggcaggaggtcatagctagtggcaagagacagatgctgtctcattgtatatgggaggaattaaactgccataggagtgaataataggactgataagtaacatttattgaatacttactataagttagacactcttctaatatatttacatgtattagctccattaatccttataataactccatatggttattataaggaaactgaggcacaaatagattaagcacatctaggaaacaactgagccaggatatgaagtcaggtcctctgactccagagtatacatcactctggagccaaagtaggctcctagcctctatgctggcagacctgaaactccagtgtgcgttagaatcacaggagggctgatgaaagcactgttgctgttccaaacctcctagtttctgactcagtaggtctgtgtggggcctgaggatttgtgtacttaagagttcccagataaggctgggtgcggtggatcgcg

SEQ ID NO: 10187 - DNA, 439 bp, Homo sapiens
atctcgaggtcaggagatcgagaccatcctggctaacacagtgaaaccccgtctgtactaaaaatacaataaattagccaggcacggtggctcacgcctgtaatcccagcactttgggaggccaaggtgggcggatcccttgaggtcaggagtttgagaccagcctggccatcatgatgaatcccctgtctcgataaaaatacaaaagttagccagacgtggtgatgggcacctgtaatcacagctacttgggaggctgagacaggagaatcacttgaacccaggaggtagaggttccagtgagctgagattgtgccactgcactccagcctgggcgacagagtgagactctgtcttaaaaacaaataaacaaacaccttcaaaaaccataccttattttatcctttatcctgtgcatccttgggttctcaaactcctg

SEQ ID NO: 10188 - DNA, 515 bp, Homo sapiens
taacacagcaaataattccctttggcccttgctctttattgccttccaaatatggaacaaaatgcttaccattttcttcctcactgtctagtcaaacttactcatcactcctcctaatcttatctcattcagccattctaattacccttctgtgaattcctcctggctgtctacatgtaccaagacttccgagcagagtctcatcagagaagtagggtatctaagacatactttatagaggctacaatttgaataacaggaacaaagaagaaataactcctttgtccaccttcaaaacttttgatacactgcaagagcctgtaatttgtaaaccatttaatctcacaggggggacctaggattctcagagtccgctccatcagggcaactatttacagcagactttcctcagatatacttgttcactttgtgctactccctttgatgtaggtataattaagctgattgcagccccagttggccactatgttcaaagaaaaaacccagtagcaatt

SEQ ID NO: 10189 - DNA, 347 bp, Homo sapiens
ggattccttaaaccttgagccttggaggttgaggctgaagtgagccaagatcacaccactgcattccatcctatgtgacagagtgagacactgtctccaaaaataaaataaagatttaatcaaaataaaatatggtacataaaaatcaaggaagaccatgtggccatataaaaacacaaagccaggcactgtggctcatgcctataatcccaacactttgggaagctgacgcagatggattacttgagatcaggagttcaagaccagcctggccaatatactaaaaccccgtgtctactaaaaatacaaaaaatcagctgggcgtcgtggcaagtatctgtaatccc

SEQ ID NO: 10190 - DNA, 211 bp, Homo sapiens
cccaaagtgctgggattacaggtgtgagccaccgcgcccagcctctgaattacttttctgcttactcaaagattagcctgtattgcggtgctcacttaaatccagttgcaacattacaaaccagccttatatatttggacatgtttactgtttaatgtaccgtaaaaataggaaatttgggttgggtgcagtggctcacgcctgtaacccc

SEQ ID NO: 10191 - DNA, 393 bp, Homo sapiens
ttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctg

SEQ ID NO: 10192 - DNA, 433 bp, Homo sapiens
caaaaataaaataaaataaattagctgggcgtggtgacgcacacctgtagtcccagctactccagaggccgatgtgggaggatcacttgatcctgggaggtggaggttgcagtgaactgatatggcaccactgcactccagcctgggtgacataatgagacacccagaaagaaaagtaataatatatgccttatagaggagatattgcttagtatgtatacatttattttatttagatatattacgcttaaagaaactttttccgccccacagacagagtcttgctctgtcacccaggccagagtgcaatggcgcgatctcggctcactgtaacctctgcctcccaggttcaagcaattatcctgcctcatcctcccgagtagctgggattacaggtgcccatcactgcacctggctaatttttctactttta

SEQ ID NO: 10193 - DNA, 465 bp, Homo sapiens
ggcacgaggagcatatgaaaccaaaatttatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttcctttttttttttttggggggggggtggggggaaaaatttttttttttt

SEQ ID NO: 10194 - DNA, 350 bp, Homo sapiens
ggcacgagggggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcacca

SEQ ID NO: 10195 - DNA, 411 bp, Homo sapiens
ccccctcaagcaatacatcaattcccttcacaataaacgtgggggctacatgactatctgtgttgaatgcggtctgaaatgatcctatggattttcccggctggttgccactactgtacaacattcagtgcccacatccatctgtgccattaagcttttttgagacatgatagatgcctcttccctgctgtatgacatgcatttgggaagttggaaagaaatgacaaaatcacggagaaaacatccaagcttcttacctgtagatagaatcagccctcacttggtgcttattaccagttattcaagatcactaacaacaacaaaattagtagacatccaagaagcacatattaggaccaaagatagcatcaactgtatttgaaggaactgtagtttgcgcattttatgaca

SEQ ID NO: 10196 - DNA, 427 bp, Homo sapiens
  misc_feature 25, 26, 27, 28: n = A,T,C or G
acacagctcttgtctttttgcggannnnttgttctaattcggcacgagcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcgccaggaggtcagattaccagctcaccatcgagccactgctggagcaggaggctgacggagcagccccccagctcacgggctcgcgcctcctgcagcgacggcagatcttcagccagaagctggtggagcacgtcaaggagcaccacaaggccttcctggcctccctgagccccgccatggtggggccggaggaccagctgacccgctggcacccgcgcttcaacgtggatgaag

SEQ ID NO: 10197 - DNA, 414 bp, Homo sapiens
ggcaccagaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagatagcaaaggcagctcatctcacgaaacttccaggagcgcacccaacaggacctgatgaagtctctacaggcagcactttccggcaacctg

SEQ ID NO: 10198 - DNA, 398 bp, Homo sapiens
ggcacgagcctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggaaacggagtttcactcttactgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttaaaaaaaaatggggtttccccag

SEQ ID NO: 10199 - DNA, 468 bp, Homo sapiens
aaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttaaaacccgtcaggtggtgaagaagtactggtatgaggcctgctgatggcagtagaggtggtataagtggaggcatttctttcacctatttattcattaaaaacagaaactcccattaatagaaggcactgcactatgacctgcgagattgtaaaaaatatgtgaaacagctttggtgcttaaaatattaagtctgatagaacagtggttcttaattctggtatacatcaaaattatcaaaaattaattatac

SEQ ID NO: 10200 - DNA, 313 bp, Homo sapiens
cagtaattcgccaaaatgacgaacacaaagggaaagaggagaggcacccgatatatgttctctacgccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgtcgtaaacaaacaagttaagggcaagattcttgccaagagaattaatgtgcgtattgagcacattaagcactcta

SEQ ID NO: 10201 - DNA, 485 bp, Homo sapiens
gtgaagggacaagcaggtttatgtgtttaaacagaaagaagggaaaaggtactatgtgatatggtactgaaattttgatcccaatagaattcatttctcttacgttgaatccccaatcataattaagccgtatacacagattaaattaacagaagcatttcacataaatgttggtttcagtcatcaactacccatgaattcctgcccaaggatacttaatcaggattaaattttctatgaataattgaaaaacaaaacactcactggatttgttataatccgtgttggcactggattctaagtagttgccatcttgaatcctttgtaataaagccatacttttgtgtgtgtgtgtgatgccccagtattgagtatgctagctaaaaaatatcaagtgcctgattaaagaattgctaaatggttgtcaatactcgctgtataaaatgagtattcccattaatagtcactgattggaaattattctg

SEQ ID NO: 10202 - DNA, 235 bp, Homo sapiens
gaggcagaggttgcagtgaactgagattgtgccactgcactccagcctgggtgacggagcgatactccatctcagaaaaaaaagacttaataacgatattgaaattagactaataaccttacaatgggaattttgcaatgaataaaaaagaggaagaaaatagttataattagattgttttctgaagtgacattaaatggccttcaaggctcaccaaaatgtttcctgaattcta

SEQ ID NO: 10203 - DNA, 477 bp, Homo sapiens
  misc_feature 419: n = A,T,C or G
gaattaaaaataaattagcataaaaagacagatatagtgacttatcaaaccttatgtttagttttgtgtggacagggtgaacacatccaagtacaagacacagctacacatggttagatgaaagcataatattgttcttgttgtgttcaaaagttaactgcagctataaggaccactatagattattatgggaggagataactctgctcttttgttctccataaaccctggttccttttctgcactcataagaatcacagttgctggaaacatagaaattacatttcttaaactcttctgtcagcagtagattcaagtttaggttacagtaaaaagaggtactcccagaatgaaagaaaagtagaagaaagataaaaatgattattgcacaggtgcatgcatgtcatgggatgacttanaattacattttaatagagactttgtcttgctgtttcttataggtaccccatgtgctca

SEQ ID NO: 10204 - DNA, 336 bp, Homo sapiens
agcagggctttggcttcaaatcttacatctgccacttgctaactgtataagttaattacttaaccttttcttttcttttctcaactgtaaagtgaggattatactttataaggtcttttttaataagagttaaatgaattagtatatatgaaaatgcagtcatgctctgtataatgttttggtcagtgatggactgcatatgtggtggtggtctcataacttttttttttttgaaaccaaattttgcttttggtgccccagctggaaggccagggggggaatttaatttaatggaaccctccccctctgggtttaaacaatttttttgggttaacc

SEQ ID NO: 10205 - DNA, 226 bp, Homo sapiens
gctggagaatcgtttgaacccaggaggcgaagtttgcactgagccaaagccatgccactgcacttcagcctgggcgacagagtgagacactgtctcaaaaacaaaaaacaaacaaacaaaagaaatggttaagaattcaggctctgaagtcagaagcctaaattaacagccacgttctgtcactttccactatgtctcctctctaccatcttactgatgaaaatct

SEQ ID NO: 10206 - DNA, 523 bp, Homo sapiens
agcctctgacaaacccaagcccaatatgtctttcctctgcagaaagcccatcaatggcttcctgtacattgagaagaatactacattctttatcataacctacaaggccccttcataggcaggttctgtccacatttctgcatttgcctcatttactttctccttcatttgctctggcttttttacggttttttgaaaattcccatttcttttgctgcaaaggaagcttcttcagggaagagactgtgactgtcttcttcattgctgaagcatcactgtctatcccagttccttgagcacaataagtattctatgcgtgttttttaacaagtagatgaatttatgacctagtgaggatgatcaaaataagtgcataatctttaaaaatgcaaagtcaaatgtggtaagtttcttaagagagacttgatttaagtagtctgggaatttatggaggggtgctgtggtttgaattttatgtctcttcaaaattcacgttgaaaccaaatccccaatttggtgacat

SEQ ID NO: 10207 - DNA, 82 bp, Homo sapiens
ggtcggccctccatcactccccgccaccccggagaccccaacccagtacatcctgggagccctccggcctgagtcatgggcc

SEQ ID NO: 10208 - DNA, 534 bp, Homo sapiens
tgaaaatgtttgtaataaaatattttaaaaatgagtcagtgtaattttccacaggcggggcacagaggctcacatctgtaaatcccccagtactctgggaagccaaggtgagcggatcacttgaggtcaggagtttgagaccagcctgaccaacgtgaaaccccttctctactaaaaatataaaaattagccaggtgtggtggtgggcgcctataatcccagctactcaggaggctgaggcaggagaatcacttgaacttgagaggcagagggtgcagtgagccaagatcatgccattgcactccagcctgggtaacagagcaagactatgtctcaaaaaataacgtaaaataaaataaaaatgtccacattaacaaaggagaaaaaattaaatatcaataaatgcataaaaattaatatatgtcaaaatctattatctaaaaaaaactgatagcaaactaagaaaatgaacttccttaacttactaatggaaatctaaaaataatgtaaaacacaaaaaacaccaaaagcttt

SEQ ID NO: 10209 - DNA, 372 bp, Homo sapiens
gccgggcgcggtggcgcgtgcctgtagtcccacctcaacctcccaagtagctgggactacaggtgcacgctaccactcctgactaatttatttttaatttcttatagaggcagcatctcactgtgttgcctaattaactggtctcaaacttctgggctcaagcagtcctcccaccttagcctcccaaagtgttgggattacaggcatgagccactgtgcctgggcaagtttatcttacttggagttttttgagtgtgtagattcatgccctctgtttccttttctttctcacctccttctgggactccaattgataatatgtctcttggtttatttgacagtgtcccacaagttccttgggctctgttcctt

SEQ ID NO: 10210 - DNA, 580 bp, Homo sapiens
gttgctctatgaaaaacacacattagcatttttcagaacattaggaaccaaacacagtatcataaaaacatagaaaaaaaggaactaattttatcttctagtcacagatgatgttcagaatcaaaatgacatgtgactaatagtcagatatcaaattagtggagctctgctcttaaccacatattactccatatctgtttctttatggcagcaaaagacaagactccagcagtggttcagctgtataatgggaatatgaatattccagaactttctgtatgccaggtgattgggaacaacagtctcttaatattacctggcttttaaaagtattggcatacatttgaactaaagatttttttaaaaaataaaatctgtccaggtgcagtggctcacgcctgtaatcccagcactttgggaggccgaggtgggaggatcacgaggtcaggagattgagaccatcctagctaacatggtgaaaccccgtctctactaaaaatacaaaaaattagccaggcgtggtggcacgtgcctgtagtcccagctacttgggaggctgaggcaggagaatggcatgaac

SEQ ID NO: 10211 - DNA, 417 bp, Homo sapiens
accctgtattcttcagcctgactcatcacttcccttttgttcgtttctagtcttcctctccagcctctccatctgtcgttctctaacttcttcctttatttttccttttctcggtttcattgtgattgttttaaaaaccacgtctatggcaaatatacccacaggtactttttagagggcttaatgacagtgtttatcagcagactctagaaatgtgttcatgacagatcaatgcttatttttgtggttcaaaagaaagttgtaaaaatttttagaaattattagtattttcttgcgggaatagtgaaagttagttgtgtgtgatcattttttaagcatcaaagattggaaagtctgaaattgtgtttcaggtgtgttccaacctactgactttgaattcatcacttattgttactg

SEQ ID NO: 10212 - DNA, 546 bp, Homo sapiens
ccaccaataatttaaaaaaaagtcaattaaatatgcgtagcttacttaaccttttgtccagtgatcaaataacttagttctgactgttgaaattgactggacaaaagttaagccagtgaagaaattttgtgatatcatggggtctgtatttccaaaaaattaaattttttatgtctaaaagcttatgcaaatatgtattatttgtgttggattaactaataaattatttgctttagtatatgccgctttaagaacactgaaaagtcagtgtccaaataactatattctaaacgttaggggaaccaaagtatccatctctaaatgattattactaaaaataattgaagaaatttgtttagtaaatttataaaatggtaaatctgacttagttgtcaaaattagctttttccatttaattttgacctatagattttttaaaaagtggaacggttcagaattttcctattaaaacttttatttgccagcctgggcaacatgacaaaaccctgactttactaaaatgcaaaaaaattagccaggcatgct

SEQ ID NO: 10213 - DNA, 102 bp, Homo sapiens
gaggtggagattgcagtgtgccaagttcgcgccactgcactccagcctgggcaacaagagcaaaactccatctaaaaaaaaaaaaagggccgggcccagggg

SEQ ID NO: 10214 - DNA, 502 bp, Homo sapiens
acacatgtacacacacatatatgtatacgtacacatgtacacgtgtacacatacatatgtatatatgtacacgtgtacacgtgtacacatacatatgtatatgtacacatgtacacatacatatgtatatatgtacacatgtacacatacatatgtatatatgtacatatatacacatacatatgaatatatgcatatatttgtttaaagtgaaaaaatatatattgctggccaggcacagtggcttatgcctgtaatcccagcactttggaaggccgagacaggtagatcacttgtgggcaggagttcaagacatgcctgggtaacatggtgaaaccccgtctctactaaagatacaaaaattagctgggcatagtggggggcacactgtaatccaacctactggggaggctgaggcaggagaattgcttgaatatgggaggcggaggttgcagtgagttgacatggcatcactgcactccagcctgggaaacagagtaag

SEQ ID NO: 10215 - DNA, 541 bp, Homo sapiens
tggaggttgcagtgagctgagatcatgccactgcactccaacctgggtgacagagcaagactctatctcaaaaaataataataataccagacaagaaagtagattctatcaaagaaatagtaaaagtagttatatttatatctatacttgctacgactacctaacgaactctttgacagcagagactacaaaaaaactttatatgttgttcctagcagagtttgccccataataggatttaagaaaccttagtagtgaaggcggcaggtaagcaggcaaacaaatgtgccactggaatttactcagaagatatctgagataaaactcactgttacaggggagaataccagattaaactgccagatttcgaatatatttactgaatatcttaatgtgataaaagtgtactgggaagatctagtacaggacaagtgatcgattagaacaaaaaggtttggtagaatacacagtaaaatgaaatcagcttgagggccgggtgcagtggctcatgcctgtaatccctgcacttcgggaggctgag

SEQ ID NO: 10216 - DNA, 544 bp, Homo sapiens
attcttagtaaacatttaggagcaaatgtaacaggagtataatttaccttgaccaagtataattactcttaacccaagagtactgctcctgctttttacgcaaagacaatctcacataggtcgataaggggacaatttgaggctagttattgtgaagttatctgggggcagcctgggtggcctgtcactgggaaagcaggcaggtgagcgggggcggtgaggcactggaggacgtgcagtaggtagtaatgacagtaacagcgtggggtgagaaggaaaccagaatgaggaggggcagctcatttgaataaagtcaatacctgctattaaaataatcattttggccgggtgaggtggctcatgcctgtaatcccagcactttgggaggccgaggcggacggatcacgaggtcaagagatctagaccatcctggctaacatggtgaaaccccgtctctactaagaatgcaattagccgggcgtggtggcaagtgcttgtagtctcagctactcgggaggctaaggcaggagaattgcttgaaccc

SEQ ID NO: 10217 - DNA, 575 bp, Homo sapiens
ggttaacttccgtgattaaagaattaaagaattaaaagatttcccaaagaatggatacgaagcaggctaatgcacattaatccttggcaattcaagactctgaaattttattgtcaagcttacatataaattccaaatattggaaacaaggaagtgtaaaaagaaaaatcacatattaacagtgtggtgtagagattatattctctttttgcaatctcttttttttttgagacagagttttgctcttgttgcccaggctggagcgcagttgcgcaatctcagctcactgcaacctcggcctctggggttcaagcgattcttctgcctcagcctcctgagtagctgggattacaggcatgtgccaccatgcctggctaattttgtatttttagtaaagacagcattttgccatactggccaggctggtctcgaactcttgacctcaggtgatcacctgcctcggcctcccaaagtgctgggattacaggcgtaagccactgtgcccagcctctttcattaatgttttatacttttcagcatacagatcttgcacatactttgttagatttatacct

SEQ ID NO: 10218 - DNA, 371 bp, Homo sapiens
actcacgatggatatgcttttagagaaacactgtgacaaagaccctttgctccagaggaaggacctgcagtggccccaggctgtggctccagcatcacttaagacagtgtgaacatttggacacaattaaaaacaggacacttaatcaaagagcacacttacaaagtaaaggggcaggaaagctgggaggcaggaggtgcaggaccccacgtgggacaggcagctgtgtgttgttggtaccgccttcctgccatggctttcctacaccagcagagagaaagcccatttctgctctctgctgcaagactctctggatggaaggtccagttccacaggaaggaaatcctggtagctgaggcgtggctgtgcac

SEQ ID NO: 10219 - DNA, 654 bp, Homo sapiens
  misc_feature 535: n = A,T,C or G
gacatcgagtacctggtgttagtggctttcataatgtaacaggtgtttagagacaccatgaagggatagctcaatgtttttaataaattttttaagttaacttgaatcaattttgtcagagccattctagccttctgagccataaacaggagttctgcattagaaacttgaaggccactacctgttctgttgaagctgatattagaacaagtggtctttattccaacacctgttcgtctctcaattctaagagccatgcacctgctaggtaagtgcttctgggaagagtgtgaatggtgggagaagactgaaaaatggttctgggctagaggacagtggcgatttttacctgaactagctgagaaaaccgatggtaagtttcagatgggtaagttccacagatttggggcaactgaaccaaggttggagaaagtgttgggaactgataatgaactttactagaaaaaaaaaagctttcctcagatagtacaagaaaaattagaccaaaatgaaaattgaaaatgagaggatattntataatttggtttgaatgtgatgacataactgatagtcttaaagaaagctgcatatgaaatgaaacagaactttcaattgaacagacaatttttagtaaattatttccataaatttcta

SEQ ID NO: 10220 - DNA, 606 bp, Homo sapiens
actggaagggcttggggaattcctaaaaactccatttacagtgtaggagatccccttctgttactcaaagttcccttcttacagagtattctgagacatttgtgattagtatccccttgagctttgtttctaatttccaccttctttcagggctcagaggaagaaaactgaatacatatacatacacactcacacacacacacacacacacacacacacatatatataatgataaatatataaatacacaagcatgcatactcaatcacacacaaacacacacacatcaccctgatactgttagttcagtggtcctagaatttaagtcatttatttgtaccacttgactctagtgtcattcattcctaattagtccatgtttaaacataacttcagatagaagacaatgaggattttataaaacataaggtaagatatatgtctgagaaaaaggcaggtctgacacaattatggatttaaacgtttttggttgattctggcactattagcaaaaataatacataaatttatatagtgcctactatgtagtaggatacgagataagaagtagcaaagatttgaatttaacagtttttgaatgaaaac

SEQ ID NO: 10221 - DNA, 59 bp, Homo sapiens
aatattcttctgcttctacccactttggcatgaaattggataagccctaaaacttaccc

SEQ ID NO: 10222 - DNA, 496 bp, Homo sapiens
  misc_feature 53: n = A,T,C or G
acaggtgcctgccaccacccccagctaatttttgtatttttaatagagacggngtttcaccttgttggtcaggctggtctcaaactcctgacctcgtgatccgcccccctcggcctcccaaagtgctgggattacaggcgtgagccacagcgcctggcctgtaccatgcattttctttgcgttctgctattccaaaagaaatattaaatattggcattttaaaacataaaataattagaattgaaattttaaaaactcttgtttaatctgtagcatcaacttaaatgaaccatcagtggtgtgcatcatcctttgatatgactgagtctgctttttgtatccagatatcaattatttatttgtttttgcttctacctaacttcttccttctctaacaattcaagactcacaattttctaggattcaaagaacattgttttttgagtgctttagaatcatttactcattcattctttcacttactaaaaaacattta

SEQ ID NO: 10223 - DNA, 121 bp, Homo sapiens
cgtttctccagtcactaatggagtcagcattaatctttcttgatggtcattttgtcattcctaaaatacattttaaaaaccacaattggggctgggtgcagtggctcacgcctataatccc

SEQ ID NO: 10224 - DNA, 220 bp, Homo sapiens
aattttatttttggtttacagaatcagtactctttcaactttaaaataataattacttactgagataataagtcagaactttaaaaattaatttgttcaacatttgtttattaagtgtctgatgtgttagggactgtttttggtgctggggacacagaattgaacagtatctgatgccatccttgcattcctataacttacctggcaggggggtggggga

SEQ ID NO: 10225 - DNA, 421 bp, Homo sapiens
gacggggtttcaccattttggccaggctggtctcgaactcctgacctcaagtgatccacctgcctcagcctcccaaagtgttgggattacgggcacgagccactgcacccgacttcccttggcttttaattacagcactaaccactcttaggtctaatgatcaccttaaaatagtggccaaatattggccttgggagaacatccccgaggagggaatgttcccttccccagccacttcccctgccccggtccctgtccctgctgcagctactgggactgagtcccaccacgtggttcatggaggctgacccagggaaggacctgcccagcccccatgcagggcattcttgcattatctgggaaattcttctggcttctccgtacctgttgagactgcagaatgggtgacatttgctgagct

SEQ ID NO: 10226 - DNA, 669 bp, Homo sapiens
ttggcccggcctgtggtgggcactcactaagtgtctctggtaccggggccagtgatgggcactcagttagcgtctctggcctgagtgttgcttggctgctttcctggtttgacactgcactttagactattgcagctaaaattaacacacatcatctgttgatgtgatgcttgcctccttttaagcttttctcaagctttcaaaatttcttcctgaagtttttccttcacagatgaaattgctcctgaattagaggtgatttactccaggcttccttgtgcttaaatgtggcaactttcaaggctgccttcatttttgcctcagagtttataaagcagcttagtgtgaatagatgctgtagggccgggcacagtggcccatgcctgtaatcccagcactttgggaggctgaggcaggttgatcacctgaggtcaggaggtcaagaccagcctggccaacatggtgaaaccctgtctctattaaaaatacaaaaattacccaggcatggtggcaggtgcctataatcccagatacatgggaggctgaggcaggagaatggcttgaacccaggaggtggaggttgcagttagccgagatcgcgccactgtactccagcctgggtgacaaagtgagactctgtcccaaaaaaaaaaaaaaaaaaaaaaaaaa

SEQ ID NO: 10227 - DNA, 464 bp, Homo sapiens
  misc_feature 403: n = A,T,C or G
tgccactctacctactcataggaacttctaataaactcatctgtataagaggaaacatccttggcatgtcatgggtctttgcagagattaatgtagtaaataagttacatcgaacagttcctaactctgctctagtgacaacagcagcagctggcccccttgtcctcatgcccactccctatacaagagtggattctgtgcccttacttaagcatcattgtctccttgtgcagtgttcaccaggacccgcagcggggtgagtttactaagatggtgttgagtcctggttcccaaggacaggcctcacagcctgtgtcagaaaacagcacaggggaggtgtaggtccgagaggtgggttgtccattgcagtccacctatcaccttctccagacaacgcagcggngctgctctgtgctaggagtattattgctttctgaaattgtgcagggatctatgcactgctc

SEQ ID NO: 10228 - DNA, 512 bp, Homo sapiens
gtttgaatattcagtgcactgactcttacattcagagaaatcttatctgtagtaagcagacctaggatgcagcttgtttgcctttcactctgtagcttcagcaacagcaaacatcattttgccaattttgttcctttcttttgactgcaatcatcttctttctttgtcctagaccattagttttgcggtactcatgagcctctctcaactcccttgagagtgtcatggcatcctctaaaggtaacttgtgggacatgcaaatctctctgccttgacatctttcactcctacaggtagggtttgatgctttacctttccactatcttgtggcgtatctctttcctcaacaccaccaccccccaacccccgcaccccactactggcttcaactccaaaacttagagcatggttgggtgtccatcaccttctctttttgcaggaactatcaaatacatagataagtgtataatgtgtacaactaatgcccacatttcatcactaacataaaaatg

SEQ ID NO: 10229 - DNA, 549 bp, Homo sapiens
atatgttcttaatacaggctgtaatatataaattggaaacaggaggaaaatagagtcaatctaataaaggaaatttttttaaatgaatgcaaatgtacagaaaaaaggcattaaacaactaggtgaaagataaggaagacagataaaggtgatcctatgattgggtccctgaaataaggaacatttccatgaaggaagaattggatcgtctaatcaaaagggcacaccatatattaaggaacactcacacaatgcaaacatcaccaaaacatattctggttattaaaactggagtatgaataacaattatttaagtagtcaggcagaaaaagcaagttatgtgcaatgggggaaattctccctagcctcagactcttctgtagaagctttccatgctagaagatagagccaaagtcataagggaaagtaaatgtgactccaaaatactttaccccagacaagttgttcaagtgtaaaagcaacaggtagatattctcagatatgaataaattaaaatttcaggaaatatagccctaatgagctcctctt

SEQ ID NO: 10230 - DNA, 477 bp, Homo sapiens
gctagagaaaagaggatgttagtaagtttatcataaagaagacaatacaaatttactgttcattaagtggaaatggatcataaaggtttcattctcaagttcatgtcgaataggaggaggagaagaactgcttgatcttgctatctcagggatagcagaggcagaagaacatctgcaaataagtagaccaaacatttcaaatctgtgttgttcaaggatccactgtacagtaatgctaagaaaggcagtggacataatttttaaaaagaactcagatccttaatttatccccaaattcaataatataacaatttttaaaatagaatttgtatgtttgattgtcagagatagatgaaataaaacaaaccattagaaataaaaaattgtttaaaaaatgcatcagtatttagatttgaaaaaatcataattaaaatattttcatcactgaatttaaaaaaatctataaatggatctaac

SEQ ID NO: 10231 - DNA, 613 bp, Homo sapiens
ttatgtgtttcaactttatgcctgacttataataatagttacaaatactacattgctagtaacaccaatatctaataccatttcctctttcctaatttcttgcagttgaagaaatggagatgagtatgtctatatgcttcactctttcctcagcaagatttatttagcatatgttttgttccaggcaccggctaagtgctaggggtacaaaagttgttttgtctcccttccttccagatgtgtccatgtgtccaggctaacagagtgagtagtcacacaggcaaatcattctcctacagttgtcaggctgaaggctgacttggtgtcataaataaaaaggcagaagatatttgtattcattgtcttggatgatattttcaacttgagtaggcagattgaaaagaaaaatgcggccgggtgcagtggctcacacctgtaatcccagcactttgggaggccgaggcggtggatctcctgaggtcaagagtttgagaccagcctggccaacatgatgaaactccgtctctactaaaaatacaaaaaattagctgggtgtggtggcaggtgcctgtaatcccagctacttgggaggctgaggcagaagaatcacttg

SEQ ID NO: 10232 - DNA, 500 bp, Homo sapiens
  misc_feature 355: n = A,T,C or G
gtactgagaaaacaacccatctaaagcaaatggctcttcccctcatttcttttaatccctcaacaggtcatgttctagagctgggctggtgagtaatgaaagtaacaagccaaatgaaaatagccaaaaccacggctaattcatcctagttaaaaatgtacacacgtgaatacacacacctcccaccacaaacaccacactgtctgcttcaattctcatctcacaaaagttttgcttatctgttttaactaatgtgtctttccccatcagtcgaacagtatttcccaagacacaacgatgtgtgaaacaggaactgttatgcatacaactttctcagtctaaaatcatggtgganaagcgtacaaaactcctttgtttttagctggtgaggaaattcttctctgagccctcagaaatttcatcattaaattgtgttactgctgaaatacaatgctcataaagtcatataatctccaagctggacagtctgagtgtgaaca

SEQ ID NO: 10233 - DNA, 175 bp, Homo sapiens
gaggttaagagatttcacctatgggaaccaggatagaaagtggttcaagccgggcgcagtggctcacacctgtaatcccagcactttgggaggccaaagtgggcagatcacttgaggtcaggagtttgaaaccagcctggccaacatggtgaaaccctgtctctactagaaatac

SEQ ID NO: 10234 - DNA, 546 bp, Homo sapiens
ggaagctagagaactaggaccggaagaagaactgagtgttcggagatggagaaatctctcatcatccttgcagaagacaaatttgatatcctctgtccttgtatgctgttttcttaccatagtctgctgaaaggtcaagcagaaggaggaatgaaaagaggacattggatttagtgtattaaataattcaggcaacactagcaggagcaatttcagtggagtggtggatgtgaaagagccaaagttggactgggttaaaaagagtttagggaggctgggcacggtggctcacgcctgtaatcccagcactttgggaggccaaggtgggcagatcacgaggtcaggagttagagagcagcctggccaatatggtgaaaccctatctctactgaaaacacaaaaaattagctgggtgtggtggcacatgcctgtagtcacaactactcgggaggctgaggtaggagaattgcttgaacccagaaggcagagattgcagtgagccaaaactgtgtcactgtacttcagcctggtgacagagcaagactc

SEQ ID NO: 10235 - DNA, 494 bp, Homo sapiens
tcacaggggaatgttgggtgttattttatttcaggattctgatacctactctaccacttgctggctatgccatcttcacctacttgcacctgttttctcttctgtggataggtgatcatacatcccagtttgcctgggaacacctagacctaatcaaccgcaggagccacttgcactctcaaaggtggcctggtttgtattaaaaacactggggggcctggcgcagtggctcacgcctgttatcccggcactttgggaggttgaggcgggtggatcatgaggtcaggagttcgagaccagcctggccaacatagtgaaaccccgtctctactaaaaatacaaaaattagccgggcatggtggcaggcacctgtagtcccagctactcgggaggctgaggcaggagaattgcttgaaaccggaaggcagaggttgcagtgagctgagatcgcgccactgcactccagcctgggcgaaagagcgaaactccatctt

SEQ ID NO: 10236 - DNA, 125 bp, Homo sapiens
gtaaactgaaattaaaataccaaactaaactacagcacctattatacactcacatccttatctcatttgaacctcacaacaaccctgtgaggtagtctgggtcattggccctaatggatagatca

SEQ ID NO: 10237 - DNA, 440 bp, Homo sapiens
gatcggtcaccaagggtcatgtctgcacttcaccacgtgccaaaacaacactagatcccgcccactcagcccctagcacgggaattggactgagattcctccaaccccaacagcagcgcccagtggggtcaccaaacaagactccaactgaccaagggcagcaggctggggacactcacacactctgggggagtcctctgaggctggtgtggaggaggctccaggggagaagccagcaggaacgtgggagggagagggtggtgccaagaggagtgggaggagccctgggaggggagaggaggacaggggaggaccgactagacagggtgcaaggcaatgacgcaggcctggccacgccagctttctcgctgggtggctgggtggagggagggaagtgctctaagccaggcagccatggaggtgggagggatggggatgga

SEQ ID NO: 10238 - DNA, 560 bp, Homo sapiens
tatcagtcattacccttgctcaagcccagactgggtcatctggccacagcaggagatgcagcgggcaacagcagcaggagatgcagcggggaacagcagcaggcatggagctgagacaagatttcactgtgaagacagtttccggggagaggctgggtccgaagctgcatctccatgtcccaggagtacctttcaaagcttcccctgtcctggcctcaagctctaggagctttgaaaaaaatgcttgcattttgggccgggcctggtggctcatgcctgtaatccctgcactttgggaggctgaggcggacagatcgcttgaggtcaggagtttgagaccagcctagccaatatggcgaaaccctatctctgctaaaaatacaaaaattagctgggtggtggtgggtcagcacctgtaatcccagctacttgggaggctgaggcaggagaatcacttgagcctgggaggcagaggttgcagtgagctgagatcacgccactggactccagcgtgggtgacagagtgatacgctgtctcaaaaaaaaaaaaaaaaaaaaaa

SEQ ID NO: 10239 - DNA, 650 bp, Homo sapiens
tctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcggggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactggacagttctgtgagaagtacgaactggacgctcagctccactgagctggctgcgggc

SEQ ID NO: 10240 - DNA, 614 bp, Homo sapiens
ggcacgaggagagagagagagagagagaagagagaggagcaagcaagggaaatgccagatagctataaaactatgagatcccatgagaactcactcagtatgatgaaaacagcatggggaaactgcccccgtgatccaatcacctcccaccaggtcctttcctcaacatatggggattaagaggattgcaattcaggatgagatttgggtggggacacagccaaaccgtatcagcatacctaggttactagctcatatctggagccagcaatggggtttgtcccaccagaatcactcaagcgtagagtgatatggttccccaaaggaaaactaaggtgttatttctagacaaaaaggattcaatgctgggaaggcaaaagcagtctatctattccacagtaggatgtgagtcatcagtacacaggagatagtaagaaggctaggagtagtggttgacacctgtaatcccagcattttgggaggccaaggcaggtggattgcttgagtccaggagttcaaggccagcctgggcaatatggcaaggccttgtctctacaaaaacaatacacaaatcagctgggtatggtggcatacacctgtagttccagctactc

SEQ ID NO: 10241 - DNA, 664 bp, Homo sapiens
ggcacgagccaggaggaccctcgcttcctctccgccatgcttgccacctcttgcttctgagagtccatctcagttcgcagttctgtgacttgcattgacctggctccaatcaagctacaactcaagcagtcacggggagaaggattgtagatgggccagtgactcacagggtcaggcactcgggggagcctgagtcaggaggtcagtgggccctggaagggagggggcaagcctgggtgggtaaggttctgggccccaggcaagaaggcagagtttctccgcaggggtgtgtgcaagagctagctgcgcagaaggtctccgctggctctccaagccgggcttgtgaaataggaacgccaacatcctcctccacaggcagtggcaggcacctcctcctcaggtgccccccaagccctatctgatgggcaaaggtgaacgcagggcggtgggcttttcctgtgcagagggagactgattcaaagggtcatttatgacctttcacaagtcccacatcctgcccaatggccaggtcttgggatgctgttgcaagatggttctgtgactccatgtgactgtctgatgattgccccagctggggaaaaggctcccatgtctctttctcataaaaccagtgggcaaggccgggcgcagtggctcacgtctg

SEQ ID NO: 10242 - DNA, 648 bp, Homo sapiens
ggcacgaggagacactccctgtggtctgttctaaaaatagcagtgggaacagagctgaggggaagaggagggggctccttcgggagctgggtggggaggcctcacccccttcctcttcctgccaggcccgatgtgaggaagtcccatggagtcacataattccatctgggagagtcctggagccatcagccctcacaccccctcctcatacaggcgaggaggccctggaggcccggagagcagaaagcactggctggtgtcaagcaagcccagagagaagggcccagttggcaggctgtttttccctggctgtttcagcacagtggctgcaggccttgtgctgaggtttgctgtcactgcctttgggcgcacagagactgggaactcctgggaccggatgtggtcaggcttcctgagagtcgcctggcaggcgaggagtccccagctggcccaccctgagccctgacctcagccagccggctgtccagtgccacacctcctcttgctggtgtcccctcccttgctgacttgtcctcctttctttggactgtctgcagggagggaggacaagggccagcctagatctggcctgcaggacagaggcctcagtggctcaggacctttccctgcccctccccaggaacaagc

SEQ ID NO: 10243 - DNA, 640 bp, Homo sapiens
ggcacgaggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttgg

SEQ ID NO: 10244 - DNA, 105 bp, Homo sapiens
tgtcctcgctgggtgggccaaggtctgggacctgtcttggactgtgggagactcaccctcaccttgccaggcctctcccctgcaggactggcattgcactagtct

SEQ ID NO: 10245 - DNA, 605 bp, Homo sapiens
ggcacgagatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaagaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacct

SEQ ID NO: 10246 - DNA, 53 bp, Homo sapiens
gaagcattttgctcattgtcctacccaagtattaatagcataatagttgatgc

SEQ ID NO: 10247 - DNA, 555 bp, Homo sapiens
ggcacgaggctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcagga

SEQ ID NO: 10248 - DNA, 408 bp, Homo sapiens
ggcacgagatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaacca

SEQ ID NO: 10249 - DNA, 676 bp, Homo sapiens
ggcacgaggaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatca

SEQ ID NO: 10250 - DNA, 96 bp, Homo sapiens
aaaacaaaaccaaaccaaaccttaatgacttaggaaggtggctttagtggccgcatgaagcacaccctgattgccgaggaaacagagtgcaaagct

SEQ ID NO: 10251 - DNA, 361 bp, Homo sapiens
gctcggctcactgcaacctccgcctcccgggttcaagtgattctcctgcctcagcctcctgagtagctgggattacaggcattcaccaccacgcccggctaattttgtctttttagtagagatggggtttcaccatgttggccagcctggtcttgaagtcgtgacctcaagtgatccacctgccttggcctggaagcacgtacattattgcgaagttttgacaaagtctcaaaagtcttttttattttgtttttgagatggagtttcgctcttgccacccaggcaggagtgcaatggcgtgatcttggctcactgcaacctctgcctcctaggttcaagcaattctcctgcctcagcctcc

SEQ ID NO: 10252 - DNA, 485 bp, Homo sapiens
  misc_feature 260, 272, 387, 402: n = A,T,C or G
acgacagaagggtacggctgcgagaagacgacagaagggtacggctgcgagaagacgacagaagggaatagagttgttaactctcatctggggagagccctgagatctacagtaaagctcttggccagaatatcagaggtctttaaaggaggtggaatttctcctattatagaaatcatcggccaggcgcggtggctcacgcttgtaatcccagcactttgggaggccgtggcaggtggatcacgaggtcaggagttcangaccagcgcggncaacatagtgaaaccccgtctctactaaaaatacaaaaattgggccgggtgtggtggcacacgcctgtagtcccagctactcgggaggctgatgtgggagaaactgctgacccangaagcacaagttgantgagctgagacatgcattgactctagcctggggacagagtgaactctgtcgcaaaaaaaaaaaaaaataaaaaaaaggggcgg

SEQ ID NO: 10253 - DNA, 602 bp, Homo sapiens
  misc_feature 563, 578, 584: n = A,T,C or G
ttgagagacctggtcttactggatgaggctttggaaaccaacgtgaggcaggcgctagcacatcctgagaggggtgtgacctggcacacaggcccagcctgggcttcatgtctcagctggcaagactgcctgctcattgccattccaggccgggcagggccaaggggcttcagggacccatgccctcatggggctcattgagctcgtctcccagcagccaaggccctggcatctccaaatgaagccagctgtgggggaaggtccttctcatgagccagtctgtcctggctgggggtggcatcccagagccccatctaggatgcccagggatgtataggtctgttgtgaggataagccagcactgagccctcaccctggactgggagggcagtgggcctgctctgagccctcaccctggactgggagggcagcggctctgctctgaaccctcaccctgggactcggggcagcccgcctgctctgagccctcacccttgacttgtctcctctgttcacgtcatgccgtggaggaagtggtgaaagaggtggtgggacatgccaangagactggagagaangacagnccgctgaggtcggcaggg

SEQ ID NO: 10254 - DNA, 572 bp, Homo sapiens
ggcaccaggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtc

SEQ ID NO: 10255 - DNA, 585 bp, Homo sapiens
ggcacgagcccagtgcgactcccaatacagcggggagttccagcacgaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaa

SEQ ID NO: 10256 - DNA, 492 bp, Homo sapiens
gtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactga

SEQ ID NO: 10257 - DNA, 587 bp, Homo sapiens
ctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgca

SEQ ID NO: 10258 - DNA, 54 bp, Homo sapiens
tctagtgcagaagccaaatttgtgaagcagctagaccaatgtgaaatgattctt

SEQ ID NO: 10259 - DNA, 559 bp, Homo sapiens
gaagggtttagacaagatcatctctaaaaacctcatggttggctgagcacagtggctcatcaaccctgagccaactttgggaggccaaggcaggaggattgcttgagcccaggagtttgaggctacagtgagccgtgatcacgccactgcactccatctcttggtgtaaaaataaataaaaataaaaggctcatggtaattttaaaaggctatttttctatgacacttgattgccattgcaggggaggggacaggaatgcttggtgtcatggtacaatttgatgtaagtgacttagttttggataaagtggggtttctaaatctcagtgtggaggctttatctattttgtttgtcattggtaagattgccaactcacttcttggcaagagggatgggaaagagagggaaaggcagagagagtgggagcatggatagacatgtgtttcctgaccatgccttgctacatttctcgtttcttccaggagcctgactgctactccctgtcagttcctgaggcatctatacctttcgcctttctgtttcccgtttttccccttt

SEQ ID NO: 10260 - DNA, 417 bp, Homo sapiens
ctatacttcccaaatgaatttaagatgacttaaaataaaatttcttaacagaataaatggtttttatatgtgggaggcgagtgcctccctccttagaggctttctgcaaatcatttgtctttaccttggctctctgaccttgatgaagtactgatgaactgagagtgtttttgtcttttctctgattaccaaacaacaatcatttattaagcattcattaggaaaaagacactgcgctaaatatagagatacaaagatataaaactcaaattttctacctgtaagaagctcataaactaggcacggtggctcacgcctgtagtcccagcactttgggaggctgaggcgagaggatcacttgagcccaggagtttgagaacagcctgagcaatatgtgagaccccatctctttaagta

SEQ ID NO: 10261 - DNA, 542 bp, Homo sapiens
ggcaccagctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttgcccaagtggccaccaacatcatgcgagcc

SEQ ID NO: 10262 - DNA, 77 bp, Homo sapiens
gagagcatccggacagacgtttcgccaagatgggtggaatggccagttaaccactgggagagcatccggacagacgt

SEQ ID NO: 10263 - DNA, 429 bp, Homo sapiens
atgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaatatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttgtattttttgg

SEQ ID NO: 10264 - DNA, 192 bp, Homo sapiens
ccgccgggccgggaggcaggaggcggggtgtccgggcctggccctgcctttttttccatgtggttctctaaacctcttgttcgtaaaaagacaaaaaaacaaaacaacaaaaaagcgaaattggaacaagtaaaagtcaaatcgattcagcaaatatttacggtacagcgcagttgcaggagcccctccgtc

SEQ ID NO: 10265 - DNA, 409 bp, Homo sapiens
atcacattcctgaatgttgaaattatatggcttgaaatgatcaacatctcctttgcttctgtctctgagcagtcctaaatcccgttaattcctgcttagaattcctcagatcaccctctcctttccgtctcctctgccaaccctcaatcacgcttattacctctcgctggcatgtctgaaccctcctggctttccctcttctaaacaagtcagccacatttaactttctgatacaatattttaagaacatcatgttttaaatatattcaactataatttgtcaatttctaattttaaaaataaaaattgaaagagcatcatttttttcctcagaaaccttcaacagctcaccactatctatgtaaatatgtgtttgtcttccgtagtctcaggtacaaacgttgcatca

SEQ ID NO: 10266 - DNA, 242 bp, Homo sapiens
tattttgagttgaaacgttgatgggagatgcttataagctgacgaattttttttgtaatgactgttatttatgtaaaaatttaaaagcctcatttaaaaatgaccttccattaatttgttcctcgatagcaataatctttgcaatagtttgaaccagtgtcattttacaggttagaacccggcatgcaaatttaaagtcttgtttacatccttgtaaggagttggatacaaagctgactaaa

SEQ ID NO: 10267 - DNA, 339 bp, Homo sapiens
gcatagaagctaagaaatagtaaaacttatgtaatcacattatgcttgggaaactgttttcttgcaaacaaaggtatttgtctcttatttattgtgttgatcatgaaaatagtatctctaccctgaggtgttacaaaaaattaatcaagtcagcatgtatactgcatatgtgtcttctggaatatttaccatttaatcaagaacctaaaaaatatataacctagctcccaaaaagtaacatcagtggttaattgtcaggttaaagaaaagtaaaataaggctgggcatggtggctcacgcctgtaatcccagcactttgggaggtcgaggtgggtggat

SEQ ID NO: 10268 - DNA, 89 bp, Homo sapiens
ctgataagggccttcaaggcgcccgacaacttgtttacgggccttgttttcagagattctccatttgatgtatcccggtcttgcagccc

SEQ ID NO: 10269 - DNA, 576 bp, Homo sapiens
attgtttttcttccagtttttctttttccaaaaaagggattcaagctggcctgcaaactcaaatggcttgtacatagttgagattaaggcaaatacacaagattgtatcctgtttttttcagctacattatacacaagtatcttcccttgtgataatgtagtttttataaatataagtttttaataactaatatttcattatgtgatacatcatgatttattattttaaaccatttctgtattgtcttgttttcaacttgggagtgttctacaaaattctttaacaagatctgtatgcggcagactcagtggctcacgcctgtaatcccagcactttgggaggctgaggcaggcggatcacctgaggtcgggagcttgagactagcctggccaacatagtgaaaccccgtctctactaaaaatacaaaaattagccgggcatggtggcacgtgcctgtagtcccagctacttgggaggctgaggcaggagagtcgcttgaacccaggaggtggaggttgcagtgagccaagatcgtgccactgcactccagcctgggtggcagagcgagactccgt

SEQ ID NO: 10270 - DNA, 397 bp, Homo sapiens
tttccctgctcacatgttacctttgacacactctggatctgaggaagtccctaattatctcttgcttttgcagactgcttacttgctgtgtggctctaagcaagttacttagcctttctggttttttttttcctcgtttatgaaatgaagatgatatgagcacctaattcatagggctactgccacgatatttaagttatttaacaatgactggcccatggtacttattccaggaaacaaatgagtataattataagtattttcaggacaattctctgtgatgtaatcactcctattttacagagaaggaaacatatttggaggttaaatagttgcccaaggccacacagctattaatagtggcaaggccgggcacaatggctcacacctgtaatcc

SEQ ID NO: 10271 - DNA, 317 bp, Homo sapiens
tggcccatcttttaccacaaggcacctcccgagtagctggggttacaggcgtctgccaccacgcccagctaattttttgtatttttagtagagacaaggtttcaccagattggtcaggctggtctcaaactcctcgcctcaggttatccacctgcctcagcctcccaaagtgctgggattataggcgtcaaagtgacttttaataataaattttaaaatcaacaataacagcgctaatgaaatgcttcctctgtgccaggctctgtgccaagccctctatgtgtattgtcttattccatcctcataaccactctatg

SEQ ID NO: 10272 - DNA, 360 bp, Homo sapiens
gaattgtttaaaaccagagatgtgcctccactttaatcctgcagagaactccctgattgctttgtcttctgaattggtgtttattttcccaaaccctagccagccttttgtaatttgatcatcagggagaattctatttattgcaatatttggaaatatacttgtggatagcctcacattaggatgcagcaaccagcatgagggtccttttttcctcttcatttgcccagccaatatacttttgcttttggttagcaaaagtccttgtagaaattgtaaattacagaaagaaaacaaaatttgcccctaagcacagcacctagtaatagttattgttttttcttttttttttttgaaaag

SEQ ID NO: 10273 - DNA, 621 bp, Homo sapiens
tatacttttctagtatatactttttctgtctcatacgattttttgtattattttccagttatctagatacataaatataaaatatttatgtttgctattttaattaatagaatttggcatattatagtagtagatggttaattaagtttgctgaattcaattttgaatggatcttacatctatttcactgtactgaatagttgaaagaaaatagccataaaatagatattggtgcagccgaagtgaaaaacaacatctaagtctccatctttcctgtgattttctgtcctctttctagcctctccctgcctacctttccgtgtgaacaagtgcacacctatcttgtttgaggcagataatttattatcataggcaagggatattagagtgataagaaatgatgtcacccttgggccgggtgcagtggctcatgcctgtaatcccagaactttgggaggccaaagtgggtggatcacctgaggtcaagggttcaagaccagcctggccaacatggtgaaatcccgtctgtactaaaaatacaaaaattagcttgggtgtggtggcaggcaactgaaatcccagtgactcgggaggctgaagcaggagaatcacttgaacccg

SEQ ID NO: 10274 - DNA, 543 bp, Homo sapiens
gtgtttgggcaagcaatacagaaataaacaaaagtgcaaaattatagtaactgttaaaatttgatggctttatctataactctactttcttatgataatagaaagtgaggaaaagctagtcaggtagactctgcagttagccagagttcaaaatctagctgtctcttacaatctctgtcaccctgaacaagtttttaaagctctctatgtctcaattccttaaatataaaaagtaagaataataatagtgctttgagcagtacctcagtaaatgctagccattattattgctttatccttataatggccatctacttcaagtactgggtctaggccgggtgcagtggctcatgcctgtaatcccagcactttgggaggccgagacaggcagattgcctgagctcaggagtttgagagcagactgtgcaacatggcaaaaccctgtctctacaaaaaatacaaaagttagccaggtgtgtttgcttgcacctgtagtcccagctacttggggaggctgaggtgggaggattgcttgagcccggg

SEQ ID NO: 10275 - DNA, 630 bp, Homo sapiens
atctaggtacttttataaaatcagattttaaaaagtggacatagtacatccagtctagtagatcataccatctactgtcatgtaatatggcaaactgtatcattgtcacttcagtagctctgtcaaaagtgctggactggaaggcaagagatccatgttcttaacctgagtctgttactaattacacacatgaccccaggcaagtcacttaaccttttatggtgtcagtttcctcatctgttaaatgaagggattagactagattatttccaggactccttccgaaaaagtacaggagagagttgtataactgaaaggcagaaagtggaataattgaggcttggaattcagggtgacttaaaaattactttaggctggacatggtggctcacacctgtaatcccagcactttgggaggctgaggtgggaggaccacttgagcccaggagtttgagacagcctaggaaacacggcaagaccttgtctctacaaaaaataattaaaaaaaaaattagcctggcatagtggcacatgcctgcagtcccagcttctcaggaggctgaggtgggaagatcacttgagcccaggattacaagactgaagttagctatgttcacaccactgcagtcc

SEQ ID NO: 10276 - DNA, 557 bp, Homo sapiens
gcctcctgagtagctgggactacaggcatgtgccaccatgcccaactaatttattttattttgtagagatagggtctcactatgttgcccaggctggtctcaaacccctggactcaagcaatcctcctgccttggcctccctaaatgctaggattataggcgtgagctatcatacccagcctgtgttgttttttaacaatatataataaaagccaacatttattcagcactgaagtattttatacacattagctcacttaatttttacaacaaacctgtgtgggaagtactgttataattaatcgtcattttcagataagaaaatagcagctgaaaaagtaaaaataatttcctcaaagacagccagggcttaaatcaggcctttctgatgtagaccatgctcttcactaccacagagttccatgctactttctctccctctccctcctctcctgtccctgctacacacacacacacacacacacacacacacatgcacactcactcacacacacgctatctacgtagatccagacatgataagatacattgatgag

SEQ ID NO: 10277 - DNA, 274 bp, Homo sapiens
ggagaccaaataaacactgtcaaatgcaacagacaagaggaaaaattgaactaggataaaaagtcaaaatttcaagtgaagctaacacctacatagcagttgtgtgccaggtacagttcgaagtgccatatatatatgttaataactcaccacagatctataagtggatactattattacacctgtgttacaaatgatgaaataagaagccgggcttggtggctcacacctgtaatcccagcactttgggaggacaaggcgggtggatcacctg

SEQ ID NO: 10278 - DNA, 479 bp, Homo sapiens
ggcacgaggtcatgatcaactcagtataggttttcttaaaaaattttttcttaaaatgttttttgaacttcaaataagtttggttggtgctacagatttaaatcgacttgtttgtgaggataatagaattctttttgctatgaacttatcagtcagcccagcgtctgtgagacggtgcctgcttgcatggtgcagtccagagtgtattttgcaaacgtctagcactgcctttatgtaggacgcgtgcttcgttttattggtctaaaatttcccatgtcataacactttgatcatgccttagagaagtcttacagcttattcagagcactttggagacattaacacccagcgtgcaaatgcgtcttcttgcttaggcgtcttgtgccttgtgttcagcatcagtctctaggcccgcttggtgtggttctggaccagagaaagtgctggtgagaagatattcctcagcagtgttgggagag

SEQ ID NO: 10279 - DNA, 134 bp, Homo sapiens
cgccgggctgcccagcctggctctgtctacactggccgagtctctgggtctgtctacactggccgagtctccgactgtctgtgctttcacttacactcctcttgccaccctccatccctgcttacttagacctc

SEQ ID NO: 10280 - DNA, 594 bp, Homo sapiens
ggcacgaggtggctggcaccccaccctgtcttctctgatctggtgctggcgtagggccgtgggggtaagtcacgtctccccgtgggctcagggaggcctctgcacttagggtctgaccagcctccccactaggaacagggtgggaaagtctgctcctgagccaggagtcaggctgggagtagcaatgctgggatgggaggtgtgtggccctcatgggcctcctctgggaagcccccagcacagatgtgggcccactcagaggctgcctcctggacctccccttctgctggaccccggcgtatgcctcagctaagcccgtatttcattctgctcagatgctcagaactctagacatttgcctccgcaattatatcccattctcctggaggaccaggaccatgtcatattcattgctgaacactgcacagtgcttggtgtggggctggtgcctgtgagagtctgcacaatgtgtgaggcccgctggggcccacgaagggtgcaccaggttcccagcctcgctccatctcagaggtgtcctgctgtgtacggcggtggcccacggatgccgagagagcctgagcacgtgtcacacct

SEQ ID NO: 10281 - DNA, 148 bp, Homo sapiens
tcggcacgaggagagagagagagagagagagagagagagagagagagagagagagagagagagagagagagagctgaagcagcgcgctcgctctctctctctctctctctctctctctctctctctctctctctctctctctctctct

SEQ ID NO: 10282 - DNA, 216 bp, Homo sapiens
atgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagttacttcattgtcttgaggcttccaggttttgtttttgtttttgccaa

SEQ ID NO: 10283 - DNA, 634 bp, Homo sapiens
ggcacgagcgcgggagttccgcaggtttcccgtgttcgcagcggagccggaggccagactgaacccggctcgtggagagtcccgagataggtaggagcgaggggtacccataggtacgcagttaacatggcacctggtaaaacaaagtgaataagatgggcttaagtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaaacattggccacgcagtacatgcagatgctacccaaggaaaagcagccagtatcaggctcacagggggcacagtaccggaagaagcagctggcaaagcagctccctgcacatgaccaggacccttcaaagtgccatgagttgtctcc

SEQ ID NO: 10284 - DNA, 572 bp, Homo sapiens
attcatggttcaaaatagaaatcgtaatgaaaattataaaaatcttttaaaagaaaacccaacattaaaacctgcatggtgcagctaaaggtgtgtgtggagggaaactgaccttaaatgcaaatattagcctggaaatcagactaagaaatgagcaacagcaaattaaaccaagacataacggaaggcaggagacagcaaagggcggcagtgaacgcgcaagcacgcggacacgtggcagggaggactaagacgccgaaagttctttgaaacacaaataaaatcaataaagtctcagataactaacacgggaggaaaaaggtgttatcactataggttccatcacattagatcataagagaacaatttaatgctaataatcttgaaagtgcagatgaaatggacacattctcagaaaaacacaaattaaagcatcatactctgggctgggcacagtggcttccacctgtaatcccagcaccttgggagcccgagacgggtggatcacctgaggtcaggagtttgagaccagcctggccaacatggtgaaactgtcgtctctactaaaaata

SEQ ID NO: 10285 - DNA, 192 bp, Homo sapiens
gcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagaga

SEQ ID NO: 10286 - DNA, 568 bp, Homo sapiens
gtcgtacggtttatacttcaccgtacgactcctctcccccactcctttgtgagtctggtctcttgccagtttcttaccctgagtggtgctaagcagataactcgtggttattccaagatagcatctgagtggagccacttcaggactagagggatgtgtcctggatctttggtctgtctcatgccttgcaccaagcttgtgggtgacgtatcatgaccttgttggagtgattgaacttgatctattgagacgcaatccaggatccctagaaacaagcacggtagactgttactgtgtggcaggtgtttcagtgacctcccgtcatcaagaggtgtgtgtgacttgacaataaaaaaataagtgtcctaaaagaatttactggctgggtgcggtggctcacactggtaatcccaacgctttgggaggccgaggtgggtggatcatttaaggtcaggagtttgggaccagcctggccaacatggtgaaaccccatctctactaaaaatacagaaattagccgggcatggtggccatgcctgtaatcccagctactcgggaggctgaagca

SEQ ID NO: 10287 - DNA, 572 bp, Homo sapiens
actggactgtgaatgtcaccgagcttttctcagattttcttctctacccttaggtaggaaaggatggcgagagtaggctgggattgggtactatccttctcccacatggttggctagggtgagctttagttgagtatttctcttctcccacgtggaaagttagagctgactagaattaggttttacccttctcctagttcagttaggctctgataaaaccccagaatgttaggctctggttaactagcttctcctgagggcagagtttgtcaagaggagcacagtgctctgaagctttcagaatgattcctatttccgtctccctgctggaagctcaaggggattcttcttgagaaggtaaaattcacaaaagtatggggtcctcatatgagggagtccccctgaagtttttaactctcagacttgttctcacctagcctctaacaatttgttgattacagttcaggtttcctaactctggcaccggttcctataaagacttctgtacattgttctcaatgtttgcatttctgtctctgattatgggagcagtggtttgccctgtgacctca

SEQ ID NO: 10288 - DNA, 578 bp, Homo sapiens
gtttgccttctctccaggctggcccacttcatttggggtttcccatgccccctgcttcacatcctttgactctggcttttgttccctccctcccagaatagctctcagttcatgaagcacaccaaacgccggaagctgacggttgaggacttcaacagggccctcagatggagcagcgtggaggtgagtggggtgcaggctacagagggctcaggtggcatgaggccacttccatgtccagttcagggctggcgatgtggtgagacattaagaccaaacgctgccgggcatggtggctcatgcctgtaatcccagcactttgggaggccgaggtgggcggatcacttgaggccaggacttcaagaccagcctggccaacatggcgaaaccccttctttactaaaaatacagaaattagctgggcctggtggtacatgtctgtaatcccatctagtcaggaaactgaggcatgagaatcgcttgaacctagcaggcagaggttgtggtgagctgagattgcactccagcctgggcaacagagcaagaccctgtcccaaaaaaaaaaaaaaaaaaaaaaa

SEQ ID NO: 10289 - DNA, 386 bp, Homo sapiens
cgttgctgtcgggtcttgactgtagcccagctcaggctggaactgctccctgtccccaagccagcctccctgtctctcttcaaagagtgtgagtccctttaggtcctggtgtgtggggacacacctccttcctcctctggcccggaggcttcggagcaggagagcctggagaagtgggggcactgtcggggctcctcggtacacagaccacgggacagatgcgtggcctggccctggcatccatgggcaaaggagagactgagacacaccgatgtgtcaccatggcccggtgcccagccttgccccagccccagctgggggcagcacggagtcctcgcacggggaagtcagtgtggggcgtatgaggaccaacagctgggtcctgg

SEQ ID NO: 10290 - DNA, 360 bp, Homo sapiens
  misc_feature 360: n = A,T,C or G
tctcctttagctgctacagactccctgctctcttccctttccagcaaacactgtctgcttcctcttgtcccaccagctcttgaactcactcctttcaggctccatccccaccaccccactgcatccactaatgccaaggccacctccatgtggccacatccaatgaccatctctctgccctcaggtccctggttgaacatgtcagcagcatttgagtagctgacctcctttgctttcaagaaacttttcctgctcttggatctcttcctgtctccctagccagattttcctacttctcccttactgattcctcctaatttcctccatcatgaagcactggagtgtcccagggttcagtcn

SEQ ID NO: 10291 - DNA, 300 bp, Homo sapiens
gatgaccttgaaattaaatgggtcatgtgaagctaaagattatagaaccccttgattcctttataaacagtatttctaagataagatcaacactaatctttcaaattagttgactgtgtatagaacaacttgtttatttaaagtcatctagtctaatgcaatcaaggagtaaattataaataaccagttagcataaatggaaagaaaatagttccttttctttgaattcatttcatgtttaatttttcttgcgcacatatagaaatgaatagaaatattcccatttcaatatgcaaattc

SEQ ID NO: 10292 - DNA, 499 bp, Homo sapiens
accaagtaggactctatgtgttatgttatgaagaaagatgttttgctaacgagatccacacatatctttgatgttcaaagtgggaatatagtgtagcaagaagaaaattgttgaaaatatttccaattgtatatgttatgcatatcatctaaacataaacatgatgcattgaaaaaaatactgttggcaaagcaatttagaaattccagaaaataagccaggcatggtagtgtgtgcctgtaatcccagcactttgggaggctgaggcaggcggatcccttgaagtcaggagttccagactagcctggccaacatggtgaaaccctgtctctactgaaaatataaaaattagccaggcgtggtggcatgcacctgtagtcccagctactcaggctgaggcaggagaattgcttgaatctgggaggtggaggttgcagtgagctgagatcgcaccactccactccagcctgggcggcagagtaagtgagactccatctac

SEQ ID NO: 10293 - DNA, 105 bp, Homo sapiens
gggttcacagctgcagtgagctgcggtcatgccactgcactccagcctgggtgacagagtaagaccctgtctcacagaaataagtctaacttgaattgaaatgct

SEQ ID NO: 10294 - DNA, 482 bp, Homo sapiens
atttgtaactcacagggcagaataacagctctagagctcaatttatctggaggagattcagcacacctgcttctctttttccactggcatggctcttggtgcaaatttgtatttatgtaatagttagaaattaaacatcagcaccaacggaaaaatattcaacgccctttattaaacatcaaacaactttgtcaatgggaaaagctgccccaactgttttagatcttacctctcaacattgttgtcaaagtacctttccactctctggtagtgtctttgagagggtttgtctattggacttaaaactacatacacaaaggtaagataaaggttatttacacagccaatcttaaaagtagaatatcagcactctttaatcttcccatttttttgtagagacacgatctatgttgcccatgctgtctcaaactcctgacctcaagcaatcctcctgcctcggactcccaaagtgctgggattac

SEQ ID NO: 10295 - DNA, 539 bp, Homo sapiens
ggcacgaggcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacct

SEQ ID NO: 10296 - DNA, 352 bp, Homo sapiens
tatctttattaacaattgacttgaatttaaaaaaaattttagtatttttatttttaattttaatgaaggaaaaagtaaacatgtaaatgcttgctttatttttcaattttataaaagcagttaattacagagaagtgctgacatttctacttttcataggaaacttggagagaagtcaaaggtgtaaaaaggacaaattttagaaaatgagattcatgaggaaagactgattaagttcactttagttaatgaaatgtggaattatgaaaaattaaatattaaggagaaccctaatgaaattataagaatagaaaataatttactcttggcctggcacagtggctcacaccta

SEQ ID NO: 10297 - DNA, 406 bp, Homo sapiens
tcatctttgtaatatctacatgcccagtacctaatatatatttattcaatgtgatatttcttatcaattcatacctgagaattcacttaactttgccatcacatgagttctagcaagcaggaatatacagtgattatgcctagaattttaaacatcagatctgacctaagaaataacaatcccaactgtaagaaagaagtggtttggggaagtcaaacactaaagaaatactttcaaaccagtctaaaactaactaaatggttaatcttatattaacaaaaacatgcaacctagattaacaaaagcatacaaatctcaatttcattatgtgcattcattcagtttctggtcttaaaagcttgaggctaaaatcaaagaaaattataatctaaaacaaagtttaatt

SEQ ID NO: 10298 - DNA, 355 bp, Homo sapiens
taggtagacgtagtgttgtggatctacaaatttcctttacaatgtaaaattgtgtgctttcatttttgagatatctaaaatatgattgtaaggattgtctggatcgtctacatgaccagcttctaaccaaatattaccaaccaatgttggtgtccctatgtgctgttgtgtttattattgcaactgtcccaagtcaaagggtaacaaacaaagagtagcggcaaacctaataagtttgccaaaatttcacaccagatgacatcatgtgcaccatggaatgaagatttttaagtagataaaagtggtagcaaaactggaccagcacagtagcaaaaaagccaaataaaaagactcc

SEQ ID NO: 10299 - DNA, 80 bp, Homo sapiens
cttggctgttactgcaaagaaaagccctctcactaagccctgtgagtttgcatgcatgcctgtgtgcttctgtgagtgct

SEQ ID NO: 10300 - DNA, 438 bp, Homo sapiens
caccccttctttcaaactgcttttgaaaaacccctaacctatgagctttggacaagatgattggagtatgaactctgtctcccctgtgacatggttgggctcgtgtctattaaactctttctctactgtgatgctgtagtccttcatgcagcagacaggaagaaccccttggacagttataaagatattaaatgaaaaaaagttcccttatcatccccgataccacacctgactgacatagtaataacagtattgacagtagtgttagatagataataagtgtttatactaatcctcacaacaactctcctgatacatggatattattgacactttatagatgaaaatgaaaattcagaaaggttaagtgtattacaaaaatttaaatggctgacaagttacaaaaaagggtgaaattcaaatgtatttactccaaat

SEQ ID NO: 10301 - DNA, 331 bp, Homo sapiens
catgtttttaaatggttggggaaaaaaaatcaaaagaataacacttcgtgacacttacaaattatatgaaattcaaacttcagtatccataaatataaaattttattggaacacagtcacattcattcttttatgtatggctgtttttcctctacaattgcagagttgagtggttgtgacagagactctacggccctgtgctatagtttgaatctcatgttgaaatctgattcccagcgttttcggtggggcctaatgggaggtatttggatcatgaatagactgatgccctccctgcgagctgggggaagctgtgagttttcactgtatt

SEQ ID NO: 10302 - DNA, 600 bp, Homo sapiens
ctagtagctgggagtacaggtgcctgccaacacgcccagctaattttttgtacttttagtaaagacgaggtttcaccgtgttaaccaggatggtctcgatctcctgatctcgtgatccgcccgcctcggcctcccaaagtgccgggattacaggcgtgagctactgtgcccggccacttcgtggatttttaacaagagaaaaatttcaagatattgtaaatttaaaacaaaattttatgtgtaataccattgaaatgtctttaaccagtatcaatcacgtgatatgaaaaatattaaatatatatttattgaataaatgaatgaaaatcataattaccttgatcactatatttaaaatttaaatgaagcaggaaagtaaatcttcctaattatcatatacttaactgtttaaaatcactctaatgacaagtaatacgctttcaatcttgcattataattttaaaattcctgtattgtttcattcactcatccttccattaattcagtgaacaaacattgattccttacccactaggtgctaggtattatgatagattcagggagtacaaaaatgattaaatgaggggatcagctggagtg

SEQ ID NO: 10303 - DNA, 420 bp, Homo sapiens
ggagttgaaatgaaaatgctaagggaaagaagccagacacgaaaaattgcctattgtaggattccatttctatacgatttcttaagaaggcaaaattgtagagacaaaaagcacatcagtgttttttcaaggtttggggttgaatgggaattaacagcaaatgagcaaaaggaaactttttggattgataaaagtattctaaaactagattgtggtgatgactgcacaattttataagtttactaaaattcattaactgtataattaaaatggatgacatttaaggtgtgtaaaattctacctaaataaagatgtttaaaaaaaataccctgatctatgaacaaagccacaaaagaaatgtcaactaattctaaaatgagatatcatacaggtgacagtcactgttcatcatgcaatcaa

SEQ ID NO: 10304 - DNA, 591 bp, Homo sapiens
ctgaacgtacatatgaaaaacaattagaaaagaaatggaatgcttcatgaatttgcatgtcatccttgtgcaggggccatgctcattttctctgtattgttccaagtttatcatatatgttgctgaagcaagcatgccagttatctattggtaaaaagttttggaataagttttctagtaatggcagtggtctaacctatgattaatttatttttgcgatgaatagtttgtatttgtgaaagtagtaattatattggtcttaaatactaagacccattgcgccccatttagtgataagaaacatgacggtatctcctcagatactttgtttttaaagagcaggctaaagagattattgtattctgttttttctgtaaattgcgacatggtgcattcaaattagaactggaggcaggtatggttactcacacctgtcatccctgcactttggaaggccaaggtgggaggatcccttgagcctaggggttcgagaccagccaggacagtgtaacaagatcccatctacaggcgggacacggtagctcacgcctgtaatcccagcacttttggaggctgaagcaggcagatcac

SEQ ID NO: 10305 - DNA, 552 bp, Homo sapiens
gtgatttagtagacttcagtttctataacttaatcaagatagcaagtcaactgatactttcattaggatttaattttgagaggtattcccatcattatactactcttctgctggagtgacactaatcagtcatagcgttggaatcctgtttcttcctggcagagtttaggttttaaaatgataaacccctacattttatgaccctcaattcccatggtggcagcaaaaccatggaagtcctggttaagagagattaatggacttcctaaatgtctgcatctggttttccagaatgacttttttctctagatcaattttaaggtcacagcatgaaaatcacacatgtatacatgtaatccatgaaccaagaaaacaagggacaagagagaagatatgggtcatcccaaatcaactgtattagttaggaatcttcattgcaagtgacagaaactcaactccaaacagcttaagttagagtttattgacttatacagctgaaaaagaatggatgaacaagcatgtctgcacccagggacccaaatgatagtacca

SEQ ID NO: 10306 - DNA, 578 bp, Homo sapiens
gattacaggcgtgagccaccgcgccaggccaaaaatggtgacttgtatctcctttccttctggttcttttctggttctgccacttaaccctgagggaccgtgagcacgttacttagcctctctgcgccttggtttcctcccttaggaaacggggataatggtacctgtcttgtaggctgttgtgaaagttaaaagaggcctaaaggcaaatgctccattactgctaccaccaccgtcatctctcatgtctagtgactgcgcgtccgagtgcagcaacgggattcccttgcgccctccaggggcagctctccagaattgcaggctgccaagcacaactcaggcgtccctgaaggctgaaagtgaccaccgccctgccctgaaataaaaaaaattaatccagctggtttaagtcagaaaagaattgcttgaccacagcagccacatgctgtgctctcccctgggggcttctcaagtggacggctccttcggaagccttcaaactgccatggcactgccacctcctgagacccctggctacttatttattcaatactgaacacccgttctatgccagactc

SEQ ID NO: 10307 - DNA, 573 bp, Homo sapiens
gtgtgcctgtttgggtctcagagaggttagtgctgagttgaggagtagggacagaccttagataaaatccttcactagtagcttggctgcaggagtgtggtgtatgggagctatgccctagagggctccctgaattcctttgtctatagggtggtgccacatggtgtttacaaaacatggattctgggatcagagtgcctgggttgaaatcctcactctgcttttagctttggcaggtcacttgaacctctctgtgtctttagatgtttcttcatctgtaagatggggacaatgactgtacctatcaacttagaacggtatctggcaaattgtacatgctatataggaattagccattatcactactactcctatgaaggaagccccttcctaaggtgaaatgtggcctggttggcagaggagctgtggttggttctctttggggagatctcctaaggtcaggctagccagagggagaaagaattgtgcttccttgttgagactagtctttaaaaggaagctgggcagtaagtgattggtgccaaatgtcaaagaaactatttctcatctcag

SEQ ID NO: 10308 - DNA, 574 bp, Homo sapiens
tagtaaactacgttcatataggcatatatgggctaatatgctgtaggtgcctatgtgatttagaagtcttaatgttatatatcatggccattgaataggctaatgtgtttgaaaatcagaattatgtcatgcaaacaaatgcaatgaaactgcattttcattaaattcaatttttgccccaaagaatgttggaagagtgtatcagaaattactctaatgtatataaagctctatgcatgaaatctcctttgatctttgctacatttttagttaacagaattgttaacctttgtaggcattgactacctattttattcatcactttttagctgaaaggttaagaaagcttttgtgggatcatgtattatgcagtagagagtattctaatgaaggctacgtaaatattgattagaatcaaaaatcaaaacttccttgaattggccgggcacagtggctcacacctgtaatcctagcactttgggaggccaaggcgggtggattgcctgggttcaggagttcgaggccagcctgggcaacacagtgaaaccccgtctctattaaaatacaaaaaatt

SEQ ID NO: 10309 - DNA, 482 bp, Homo sapiens
  misc_feature 340: n = A,T,C or G
caatgaattaaaaggataaaaataatatatgttctctgatcacaatagaataaaattagacatcaataacaggaaaaatgtggaaaaatcataaataggtagaaattaacctactcctatgtaaccaatgggtcaaagaagaaatcaaaaggggaatcagaagaaaaacaattacagaacattgtggtaaatgcaagaatgggagctagcaaggagctaaatgtgcatatagagttgacactaattctacctaggaaaatgcaagaaagaagaaaactacagaacagaggaagtaacatttaggcaggtcttgaaagatgaatatgaatttatgtggcanagacagggagaaagaaaatgaaaaacatggaagcagcttcccaaagcagggaggtgttgaagtgaatgataaaatctgaaatgatgagcagttaggagtggctagcatgtagggtatgtggtaggagaatggcagtcgagga

SEQ ID NO: 10310 - DNA, 561 bp, Homo sapiens
tggactctacgcatatcatcccatttaatcctcacaatagcactgtgaggaaggtactgttattctctctgatttacatacaaacgaggaagtagattttgaggtaaggaaaagagccaggctcaaactggccagcccgctgcagagtctgggtcagagccactgggctgacatgtgccccatccactaggcttaaaggatactttgttgcttcctaaccaagacaggctacgtcaaaggtcagtaagaccttggccacttaaggataaaactggatgactaaggccgggcacggtggctcacacctgtaatcctagcactttgggaggccaaggcgggcagatcacgaggtcaggagatggagaccatcctggctaacacggtgaaatcccgtctctactaaaaatacaaaaaattagccgggcttggtggtgggcgcctgtagtcccagctactcaggaggctgaggcaggagaatggcttgaacctgggaggcagagcttgcagtgagccaagatcaggccactgcactccagcctgggcgacagagctagactccgt

SEQ ID NO: 10311 - DNA, 569 bp, Homo sapiens
ctcagcctcctttgcagctatctgttgcaaagcgaacaagtgggagtggtgctggtggctttgcagttagcctaggattgagcaattgctgcaattgttgctctctgcatcttcggtgttacttcttactggttgtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttga

SEQ ID NO: 10312 - DNA, 426 bp, Homo sapiens
gtgacagagcaagactacatctcaaaacaaaacaaacaaaacaaaacaaaacaaaacaaaaaatctagtctacctcttcccttagaaactttgcatcatttaacaacttgtgttagagagaattttctcccaaaaatgcctatgacttagtcaccagaatctattcatctgttaccttacatggaaagcaggactttgtgggttctattaaattcttgagatggaacaattattctggattatctagatagatacaacctaatgatataatctctttagagcaggaaatctttcctagctgggccagagagcaagatgagacaggaaaaagaaaagagtttcaaagagtgagagggacaagctttgatgttgctagctttgcagatggaagaatagggtgaaaggtgaggaatataggtggttcca

SEQ ID NO: 10313 - DNA, 121 bp, Homo sapiens
acatgcatgaatctcaaaaatgtcacagtaagtgacaaaaggtcacaaaagaatatattcagtatgacttatatgtgagttaaaaacaggcagaattaaaaatatatgtttggtaaaactg

SEQ ID NO: 10314 - DNA, 207 bp, Homo sapiens
ggatatgggtctgtagtttatgttattgtttttgcttttgttattttgtatatgtgtatccttttctggctttgtcagtgtaatgctggcctcatagaatgagtttggaagaattccctttaattcagttttttaaaaaatattttgacatgaattggtattaattcttctttatacagtaaagcaacatgctaagatggttatttt

SEQ ID NO: 10315 - DNA, 574 bp, Homo sapiens
tcctgcttcaagatatggaatcaactctcctccaaataatcctggttccttttaatggagaatgctattaaagatcacaatctgagtgctggctgcatgtgagcgtggagcagggaaggtggggaaacggggtaagcgtgctgctttggtggcaacagagacagaaacatatttacttgtaaggttgtgttcatactactctttccaacttaacacagcgtgcctggtgggttccacccacatttctcacagtatgagccttcagaggccactaagaccttctccatgcagacctaaataagaagccataaattcagcctttaccttttctccccatcccttcctgtcaggggaaggaagctggacagagattattttctgactagcagaaacagtgccaccactttactcttgtaagaaggctgccctacaaggatttggttttcaactgctttctccagcatatattctatgggaatgggggtgggtgcatgatcaactttgtattttgcacggacgcccctgtagctgggtcaaggctggatgacaggacagaggtcaggacagagaagca

SEQ ID NO: 10316 - DNA, 574 bp, Homo sapiens
ttatcagaaaacccaagagtaaagttaggcttgtgagtaatgctagtctacctaaagctgtctcaaaaatcctattatctacctgccttggaccacttgtcagtaggcaataaagaattcaacctggtatatcccggatatactgcaaccaagattatcatgggacaatttctctgccacaatatatacagatgcttctctggttcattaattttacactgcctttcatacatatttgctcaatgtcacaatataattataggttgtgatattttataatctgtataggttgaattaagtcttcaaaaaagtcttaatccccacaccttatttagaaataaagtttttgcagttataattagttatgatgagtttcatactagagtaggatgggctcttaatactataagactagtttccttataagaagatgatgtaaagacatgagggaagaatgccaaatgaagacagagggagagattggatttaagctgccaccagccaaagaacgcctggagctatcagaaagagacaaaggaggatcttccctagaggcttctgagaaagtatggac

SEQ ID NO: 10317 - DNA, 369 bp, Homo sapiens
atggcgtgatctcggctcaccgcaacctctgcctccctggttcaagcgattctcttgtctcagcctcctgagtagctgggattacaggtgcccaccaccatgtccagctaattttgtattttttttttagacaggttttctccacgttggtcaggctggtctcgaactcccgacctcaggtgatctgcccacctcagccttccagagtgctggattataggcatgagtcaccgtgtctggccgattagcactgtttccattatcattctgctttaagtgccttaaaatatatagttatttctttgacttatgaattactcagaagaaagctttaaagttttcaaatgtatgcgaattttaaatttatct

SEQ ID NO: 10318 - DNA, 435 bp, Homo sapiens
atcgcctggggttaggagttcaagaccagcctggccaacatggtgaaaccctgtctctactaaaaatacaaaaattagctgagcgtggtgggcacctgtaatcccagctacttgggaggctgaggcaggagaatcgcttgaacacgggaggcagaggctgcagggagccgagacagcaccactgcactccagcctgggcaacagagcaagactccatctccaaaaaaaataaacaaataaacaaaatgccaagagtatgctgatgtaaaggtttaagtagaaactctggttgttttactcatgtgtgtaaaccaagcccccaagatgtgccaccaaaatacagagtttgtgggtggatcagcctgtacctgagccccctctgccacactgacatgatcctcattaaagaaagaaaagagggggcaggtggatcac

SEQ ID NO: 10319 - DNA, 566 bp, Homo sapiens
  misc_feature 436: n = A,T,C or G
aacctccgcctcccgggttcaagcaattctcctgcctcagcctcccgagtagctgggattacaggcgcacaccaccacactgggctaatttttgtatatttagtagagacagggttttaccacttttggccaggctagtcttgaactcctgacttcagatgatccacccaccttggcttcccaaagtgttgggattacaaacgtaagccacggcacccagcctcaggtatgtctttatagcagtgtgagaatggactaatacagctgggtatcctcttgccaagaacggaaggattttggtaggcagttagtacattctactacagttccttaaactgactcgaaaagagcttggaatgtattataattctataatgattgaggaaattaagttagtgaattagtataaaatatctttatattaaaagaaactaanaagtcaaaacaatgaaaggtctataaacattgaaatggataaataaattatagtagattcataccatgaaatatggacagcaatttatcccacaactagagatacatgctaacaaacatgtatgcattta

SEQ ID NO: 10320 - DNA, 625 bp, Homo sapiens
agtgtgaccaaaggaaatctgaaataccatagttgatctcaaagtcttgaaagctggccatccacacaggaggcagatcatggccatagagtgaccttcctccaaagatcaggaacaaaacagggatgtccactctcacacttcatttaacattctggaggctctacacagtgcaatcaggtaagaaaaaaataatcatccagattggaaaagaagtaaaactgtctctatttgcaaatgacattattatctatatagaaaactcagtatgtctaaaagaagccactataactagtaagagattttagcaagatttcaggatacaaaattaatattcaaagataaatcgtaggccaggcgtggtggctcatacctgtaatcccagcactttgggaggccaaggcaggtggattacctgaggtcaagagttcgagaccagcctggccaacatggtgaaaccccatctctactaaaaatacaaaaattagcctggtgtggtggtacatgcctgtggtcccagctactcgtgaggctgaggcaggagaatcacctgaactcaggagatggaggtgcagtgagccaaggtcataccactgcactctagcctgggcgacagagcaagact

SEQ ID NO: 10321 - DNA, 83 bp, Homo sapiens
ctttcttataacttatatcccatgagtttaaaacctttattataaatatagttattttacaaggacaagctggacagcttata

SEQ ID NO: 10322 - DNA, 57 bp, Homo sapiens
gtcatttttccttgtttctgacttttccctttaaagatccatttaacagttacatat

SEQ ID NO: 10323 - DNA, 409 bp, Homo sapiens
gagtttgaggctgcagtgagctatgtttgcaccactgcactccagcctgggcaacagagaaagaccctgcctcaaacaaacaaacaacaaaaacaaaacaaaacaaaaaaactatctcatgggaggttctggtgagacgagtaagatcatggtggaaaatgccttcggcccactcaggaaatattcttcggcctactgaggtgcagagactcaaagagagagccctgtatggagatactcaggcctgtggcaagctgagacctggagctgtccctcactaaactggagaaacggctgcttcccagtgcccagcagtaattcagccaaaagactttcagatgtacaaatttttacacttctaaaaaattaattttctcccaatattttatgttaactttctttttttttt

SEQ ID NO: 10324 - DNA, 384 bp, Homo sapiens
cctgtgcctggctcagtttcttatttataagatatccaacagttcttaaccattaattagactttaaagattattaatttcaagtgcacattaatgtgttttttaaaagaacaagaaataattaaaagaaacatttcatttttacttagcattcaaattgcacttaatctctttcactcatagagtggatttttattaacatttacagcatcaggcagacacatttagccatgatcctgaaatcgtgaagtactatacaaagaaataaagctatttattatagtaatatccactcattttctgatgccctgaacccaaaagtgaaaatatgtgcctttagaccctcacttcaaatctaactggatgtaatatcacaaataattc

SEQ ID NO: 10325 - DNA, 398 bp, Homo sapiens
aaatgataatttatcattcctgcccaatcacacatacatacatttatgtatgcaagcaccaacatgtacacacacgagagagatatatcatcatgcaagtggaaaattatcctagaagatgtaagcacaatcattcaagaagttaaaagcactacaaacactttgggaggccaaggcgggtggatcacgaggtcaggagatcaataccatcctggccaacagggtgaaaccccgtctctactaaaatacaaaaaaattagccaggcatgttggcgggcgcctgtagtcccagctaccaggtaggctgaggcaggagaacggcgtgaaaccggggggcggagcttgcagtgagctgagatcgcgccactgcactccagcctgggagacagagtgagact

SEQ ID NO: 10326 - DNA, 376 bp, Homo sapiens
tagaagagtattctcaagtgatcccattttggaatacatttttgtttatttcgaagcggcctacggctgcgagaagacgacagaagggtacggctgcgagaagacgacagaagggtagaagagtattctcaagtgatcccattttggaatacatttttgattattgctgtgtgtattatatatgtgcacatgtacaaatgcatagaaaatattgtggagggatacacattcaacagtgattgcatctaaagaatacagctgggcgcggtggctcacgcctgtaatcccagcactttgggaggctgaggcggttggaatccttgaggccaggagttcaagaacagcctgaccaatatggtgaacccccacctctact

SEQ ID NO: 10327 - DNA, 471 bp, Homo sapiens
aagacgacagaagggtacggctgcgagaagacgacagaagggtttgtgcacaaaaggcatactgtttaaacaaactggtatctacctatcttagaaatttttattattaacagatttaaagccaaatataacaatatacgcaaaagtaggagaatgggtttctaaatttttggaaaacaataataggagttcttaagatgcatgaaaggcaactgaatttcatgacagaaatagtaagaaagaaggaataagaaaatgtttcttggccgggcgcagtggatcatgcctgtaatcccagctctttgggattacaaggcaggtgggtcacctgtcagaagttcaagaccagcctagccaatatgatgaaacctcgtctctactaaaaatacaaaaattagctgggcatgatggccagtgcctgtaatcccagctacttgggaggttgaggcaggagaatcgcttgaacctgag

SEQ ID NO: 10328 - DNA, 208 bp, Homo sapiens
gggaagccctggtgccagctgactggccaaggatctcattacctttataaacacattgattgattgattgagacagaatcttgctctgtcgcccaggctggagagcagtggtgcgatctcagctcactgcaagctctgcctcctgggttcacgccattctcctgcctcagcctcccaagtaactgggactacaggtgcccaccatgcc

SEQ ID NO: 10329 - DNA, 307 bp, Homo sapiens
agagtgaggaggaaccaggtgagaacgaggccggagacagaggaggcagggggtgagaggaggccagagacagcggccctgtaaagaaaacattcaggctgttggccgggcgcggtggctcacgcctgtaatcccagcacttggggaggccaagcgggtggatcacaaggtcaggagttcgagactagcctggccaatatggtgaaaccctgtctctactaaaaatacaaaaaattagccgggcctggtggcgggcgcctgtagtcccagctactccagaggctgaggcaggagaatggcgtgaacc

SEQ ID NO: 10330 - DNA, 401 bp, Homo sapiens
gttaagtcctattctccccactacttatccttgttgggaaacactgttgtacacagttagtaaactgatatgcagtagtagtaataaacatagtaataatactgctcataaaatttgatcttacttataataatgtcttttatttatagatttgtcaaaagacctttgcttatatcatctcactgaaaaatcacaaaagcttcaatgaccagccaggtgcagtggctcacgtctgtaatcccagcactttgggaggccaaggtgggcagatctctgaggttgagagttcgagaccagcctggccaacacagtgaaatcctatctctactaaaaataggaaaaaaattagctgggcatggtggctaatgcctgtaaccccagctactcaggaggctgagata

SEQ ID NO: 10331 - DNA, 568 bp, Homo sapiens
gagtgatcctcttgccttggcttcccaaagttttgggattacagtcatgagccaccatgcccagcctaatttattattgaagaaaaaatttaaaataaattttgtgtagcctaaatgtacagtgtttataaagtcaacagtagtgcagtaaagtcctaggccttcaggttcactcaccactcactcactgattgacccagagcaacttccaggcctgtaagctccattcttggagcttatacactttatacagggtaccattttaaatcgtttataccagatttttactttaccttttctatgtttagacatgttagatatgtttagctatgcaaatacttattgtgtcacagttgcttacagtattcagtacagtcacatgttgtacaggtttgtagcctaggagcaataggctataccttatagcctacatgtgtggtaggctataccatctaggtttgtgtaagtacacttcacataatgattaaattgccaaagttatgcatggctataattaattattttatttcctcatttagtggtcattcagtacttaagtataagtact

SEQ ID NO: 10332 - DNA, 531 bp, Homo sapiens
tcagagcctcgtggaagagaccgcattaggtactccaaactattgactcttcaaagctgagctgacatggttttggtaactttcagactgtaccggtaaactaagtcaggattcccataactctatagctgaaaagcggtttcacacaactgctaacccaagatccaatagaatgagaattaattacacaagactgaaaaaaaattgatgagagaaatttttttcgggttatttgaaatgcagttgttttaaggttctgttcccagatcgtaagaagccttttctttctcttcttgtgctatctgtaattcacaataagcttttaaattctgcttttataaaccagaatgaagtattcttaaattatatatgattctcactaacacgattcttcttatttgaattcagaaactcttacccagtctctctacatttcttggcaatatagttgtttgcataggtttagtaagaatctgtcctcccttttgccaaaatacaactgggagcatcaattatgcaatgaaagccttg

SEQ ID NO: 10333 - DNA, 555 bp, Homo sapiens
gaccatgagttcaagtccagcctgggcatcatattgatgtctcttctaaaagcactactaatgcaataaaatgtattctcattgaaaattacatctgcagacaataaaacaggaaaaaactgctgtcttttcacactcaattgtttatcttctgatctgattcatcttgccattgtgtgttgcataaaagttgtaataaactaaaatttaacatattgtggtacaaacacaccgtggaatagtggaatactatgcaaccataaaaaagaatgagatcatgtccttctcaagaacatgatgaagctgaggccattatccttagcaaactaacacaggaactgaaaacaaaataccgcatcttctcacctacaagtgggagttaaacgatgagaacgcatggatacatagagggcaacgacacacactggggcctacctgagagtggagggtgggaggagggaaaggggtacaaaaaataactattggttactaggcttaatacctgagagatgacataatctgtacaacaaacccctatgacacgcgtttacctat

SEQ ID NO: 10334 - DNA, 637 bp, Homo sapiens
ctagagtgttacgatttcatgggcaaaatacaaagttgaagtgtccctgataacacatagcaagcagcacatttcccaggaaaggccagcactgcttattctcacagaagtcacccctgcaagggttctttagatcagtggttctcaaattgagcattcaagagcatcccatggaaggcttattaaaatgcaggttgctggcctcagagctcagattcagtagaagtcagttagagtctgggaatctgcatttctatgcatccttgctctctctccctcccttcctgctgctactgctggttcagggaccacactttgagaatcactgctttggatattagaatgatgattctctcaagtcttgaaaaaaaattgcgaagttccctctaatttagcagagttaagacaaatgtttcatttaatttgcatctatacatagctctgatggactaatcctttataattcaaagggaagaatttaaaaatcataatgatgaggctgggcacagtggctcacgcctgtcatcccagcactttgggaggctgaggcgggaggatcacctgaggtcaggagtttgacaccagcctggccaacatggtgaaactccatctctactgaaagaaaatacaaaaatta

SEQ ID NO: 10335 - DNA, 593 bp, Homo sapiens
ggtgcatgttgggggttggatgacacaaatactgagatgaaatgtaaagttaactgttgttaacgcattttatgcagctaggagggcaatggaagaggaaaaaagcaggaagaacggataatgtcagtacaagtgtgacttgtgtgaggataagaagtactcacttctacggtcaccaggtcgtggctggtacagtctttatggccacgctctcccgtcactcctgcgtggtccctttgccctctgcaagcacctctgctggtcgtggttcactgtctggtggggtgacccaaacgttccttcccaaaaggcctatgctgttagcagttttgccttatggggtggttctggttttccagtggtgttttctgcaaggcttagaggagctacgtgatattacagacgatctcctgcctcccaaatttctcccccttagccccattctgtgatcaggttccaagttccccttgttgggctcagtcagccggaccagcacagggaccctcttctttgtcgaccccctggtgtgaggaaccggcgtccaggtgggcagtctcagcttcctgcgtaacgtgtcccctggtggaaacact

SEQ ID NO: 10336 - DNA, 332 bp, Homo sapiens
gtagcagatatgattccgtgtggcatcctaagctagagcataaaggacattttggcttccattctcttggatcacttggtccaggggaatccggcagctgtcaggaacagccctatgatgggcccatatggagaggaactggggtctcccacaaatagccagcacaacttgacagtcatatgagttagccatcttgaaaatggatctgattccagccccagtcaaaccttcatatgtgtgcattctcagctgacatctgactaaatctcatgagaaacttcaagatagtaaaaacccattaaggctgggcacagtggctcacgtctgtaatc

SEQ ID NO: 10337 - DNA, 341 bp, Homo sapiens
catccggtattttcacccaaagtctggcagaaattaagtgcaaagattaaaactacattcctttcaaatccaagttcaagagtggcttagacagacaacgtcaagagcagcagtgggcagaatggaggcttctggagcaggcatgtagacacccctaaatgcttaggatgagtaaaccagaactccttactgaccagactgtgtagctccagccttttaccattcccaagatgaggacggtccaggacagctttacagagataacaaagaagtaggattggcaacccaacaagtcaaagtagccgtaaccgtagccactcccatgaccaagcagaagcagc

SEQ ID NO: 10338 - DNA, 622 bp, Homo sapiens
gtgacccacttaagattccaaccatctctattttactccaaatcctaaattcttagccattatgcatcactgccttgacagctgttttgtacctgcttccttctccctgcagagtgcctgctgcactgtaggtatttaatatatgtgcttagaacgtgaactaagctgaaaagcacaccaaccaacaagtttttttgatgtcattctttctatttaaaaactgttgtgactaatgagctattttaggtctggattactgtggctgaagtaacagatatgtgatcaggtcctcctcatccccatgacacatagagtgtatgcttcccaatactgagagtcaccatttccttcctgtatattcctggtctttaatataacctcaaaccaaattccattatattgtgtacttgatgctaccattactcagcatgttaaacgaatgccataggccaggtgtggtggctagcacctgtaatcccagcactttgggaggccaaggtgggcagatcacttgaggtcgggagttcgtgaccagcctggccaacatggtgaaacccatctctactaaaaatacaaaaattagccaggcatggtggcgcactcctgtaatcccaggaactcg

SEQ ID NO: 10339 - DNA, 196 bp, Homo sapiens
aacagatgaagatgtatctcctttaaaaacaaacaaacaaaaaaagacagtttccctctgtcacccaagctggagtgcaatggtacaatcttggctcactgcaacctccacctcccaagttcaagcgattctcctgcctcaacctcctgaatagctaggattacaggcgtgcccagctaatttttctatttttagt

SEQ ID NO: 10340 - DNA, 479 bp, Homo sapiens
attctttatgtttccagcttatctatttcccagagaccaggtcatatctgattaccttacagtctatgaatatatttttgtgtgtgggaagagtgggtctacagtatgaataaagtttgcctatagtcattttctatgttgctctaaaattattctaaactcctctaataaaaacttacaaagaaaccagacaaatgtgcatatggatatgactatgaactaggaaacatccagatgccttggaaaaccctaagagaagaaggaataactcacgatatgtggaaatgcaagtgagataggtgagctggagaatatatcatcagtataagccttagatttattttgcataattgaataaaattctttacaaataaaaaggtgagtgttttaattaaacttgacaagtgacaattaagttaaacataatcttttgtttacaatcactttgattggagacagaaggaaattagaaattaaag

SEQ ID NO: 10341 - DNA, 634 bp, Homo sapiens
agccaaaatctatatggtttcttatgatttttttccctaatggattttgaatccctggaggtcaggggttcatactctccacagcaactggagagctaggacttagataaagtagacattctaacaatgtttgttaaatgcaacttttaaaatgctttaagtagaagcccttacaagtaatatctggaatctttttaagtttgaaaatctaatggctatttgtatcagatttatatgtcctggctcttaataacctcctagcctacctgataaacctgtgaaattgcactttcttccagtagataactatgctgttctcaggtgaaatacttcgcttatcccttgccagtccagcctggggaaggcagctggacctgagctgggaattttatttgagggagtggaaataggaggggttggccaaggctgagttagaggggacagctctttagtggcctgagctggctctttggtgcagccgaagattgttagaattttagaggtggagagactttagagatacatcccagtcctctattttacagatgaatgaaagtgagtctcaatgatgttaagtgactttttaaaggctacagaaggctgggtgtggtggctcacgcctgtaatcccagca

SEQ ID NO: 10342 - DNA, 652 bp, Homo sapiens
ccttgattttgatcaaataaattacaggcaccagctggccaagagttttaatcaggctttgagatagtgggtcattacatggcaagagcgcccaggacaagagacacgggtgccctgcagtgtgggaacatcatccagggcagggaatatcatccagagagaatgattttgtcttgaattttgcaaatgttgaacagatataaaaataacttcataaatgattaggagaattttttccatctttaatttcataagaaaattattgaataataattgcttaataataattgcttaaagcaagaaatagggagaagcttaaaatgcttatttaaaataaggtggcaaaataaattttaaatgcttataaatttatacatgtacatatgttgttcacagaattaagtgtataagacagtgataggccgggcgaagtggctcacgcctataatcctggcactttgggaggccgaggtgggtggataacttgagatcatgagttcaagaccagagtggccaacatggtgaaaccccgtctctactaaaaatacaaaaattagccaggcatgatggtgggcacctgtaatcccagctactccggaggctgaagcaggagaattgcttgaacctgggaagtggaggttgcagtgagctg

SEQ ID NO: 10343 - DNA, 432 bp, Homo sapiens
tacggctgcgagaagacgacagaagggtacggctccgagcagacgacagaagggttttcactatgttggccaggctgatcttgaactcctgaccttgtgatccgcccgcctcggcctctcaaagtgctgggattacaggcatgagccactgcacccagccggacttatgttttttactgatcagaccagacagtgctcagagtaaagacaccaggaatctcttggtgtcatctgcagaggcagaactggggtgcagcgttttaggctcgctgagactcccaggggccttctttcttcacaccattctaaatgccagatataggcacatggaagtcactatggaaaggaagacaaataaaacaaagtagtctatgactttcattatttggttgtgaaaaataacaataatagattttattttatcttgaagga

SEQ ID NO: 10344 - DNA, 407 bp, Homo sapiens
ttttgtatttttagtagagacagagtttctaccttgttagccaggatggtctctatctcctgacctcgtgatctgcccacctcggcctcccaaagtgctgggattataggtgtgagccaccgcccctggccaagaacattattcttaagggaggagacctggatttcagtaccagttgtattttctgattaaaaggaaaaatagcttgcctggtcttagattctcctacaaaactaagtgggttggtctggatgatcattacattcccttatcaccttagcatttcttcacaatcctttactgtgctggttattactgaagagtatttagtagtactgtagctctgtaagattaatgtcaatgagaggctggtattgaagtaatttctgagacctttaaaaattatc

SEQ ID NO: 10345 - DNA, 249 bp, Homo sapiens
tacggctgcgagaagacgacagaagggtacggctgcgagaagacgacagaagggaaaggcttaaatgcaagacctgaaactataaaactactagaaaaagcatagggaaaatgcttcaggacattggtctaggcaaagattttatgcctaagacttcaaaagcacaggcaacaaaaacaaaaacagacaaaagaggctatattaaactaagaagaaaaggaaacaatcaacagagtaaagagacaacct

SEQ ID NO: 10346 - DNA, 293 bp, Homo sapiens
agtattcttttatgtatcagtgtgaggtggacataggccgtgtgcatcccagcactttgagaggctgaggcgggcagatcatgaggtcagaagttcgagaccagcctggccaatatggtgaaaccccgtctgtactaaacatacaaaaattagccaggtgtggtggcccgcacctgtagtcccaactattcgggaggcagaggaggaagaatcgcttgaacccgggaggccgaggttgcagtgagctgagatcacgccattgcactccagcctgggcaatagagtgagactcc

SEQ ID NO: 10347 - DNA, 125 bp, Homo sapiens
gtgatcacagctgcacccaggctggagtgcggaagtgtgatcactgcaaccttgaattcctgggctcaagcgatcctccaccttcacctcccaagtaactgaaactacaggtgcatgccaccatg

SEQ ID NO: 10348 - DNA, 614 bp, Homo sapiens
gtaagaacaggtaggatgattccactttgaggaaaggtactttgttactaacgttggtaagacagcttctgctataaatgctcttcacaatccacatgtagagaattctggacaacagtatcagtccagatgccagaaaatgcacagtgagcatgacatgctcatcggctgaggtattctgacttcagctaaggacgcaatgatattttacttgagattcaggaatgcagaggatagattctgtgggagaaagaaaagctttgtttaagtaactgatctaaagacattacaatgttagctgctttcactccttcaaatcccaaatattgcctaatatttgatttgctttgcattgagaatttggaagtaaataagatatagtctctggcatccagagggtcacagtcaaataggaaaggtatggatggatattacccaaaaatatgagagattctttaagtttggaaaacttaaaggaaaaggcagattgattctctagtgctggctgcaatgggcgattcctcagagaaggcaggagaatgattgtcacctgagctaatccttgaacacatagaaattctctggacaagatgcaaaagtattagaaacagaga

SEQ ID NO: 10349 - DNA, 408 bp, Homo sapiens
tttcctggaaaatataaggtcattagaaaaatttaattccatttaatttcctccaaactttcatgttgattgttaagtattttaactctatataatttttaatcatcataagatttcattatcatggccaggcacagttgcacacatcctataatcccagcactttgggaggccgaggtgggtggatcacctgaggtcaggagtttgagaccagcctggccaacatggtgaaactccatctctacaaaaaatacaaaaattagccaggcatggtggcacttgcctgtaatcccagctacttgggaggctgaggcaggacaatcacttgaactcaggaggcagaggttgcagtgagccgagatcatgccaccacactccagcctgggagacagagtgagacttagtctc

SEQ ID NO: 10350 - DNA, 263 bp, Homo sapiens
ccatgtttcgcccaggtttgtctcgaactcctgagctcaagtgatctgcccaccttggcctcccaaagtgctaggattacaggcatgagccaccgcgcccaaccaagagcagagtttagatgtggtacccatggagacgcagactaacaataggtgagtggatacagttgtgactcagtatataaaatcttttctttggaaggctattgatgacacctcagatgccatgctgagagcatggcaaaacaatgaatgtggccggg

SEQ ID NO: 10351 - DNA, 655 bp, Homo sapiens
attcggcacgaggcttagggaacaggagtgaacagacttcagccccacctggcaggggctggctcccgaggttgggcccagtccctgagggtctgctctgctacgggtctgcccttgagtggccttccgtggagggtgtgtgaccaggtggatggtgcagggcctctggagccctctcctcaggagcagacctcaacctttttctgtaaaagactttactttggtgttctaggtggacaacaggttccaggctggtgtttacaatctcggaggaagtgcaatggttactgttcttttgacagtacagactgatttcaagacagacaaaagcgaaccaaaagcaccggacacaacaactcctctggctgtgtaaacagacctgacaatgtggccgtgcagcccaaacgatcaaagagaagccaggcgttgaccaagccccaaggtgcctgaggccatggtgcaactctgctggtgactggggcaccttggagcagagcttcacccggatgggaaatcctcactcctgagtggcactccctcctgaacaggcccagtggcagagtgtccgtgctgctgggtgctgtccccagccctcctggtccatcttcttaagatgcgtccactgctttatatttaaaattctctttttcacagg

SEQ ID NO: 10352 - DNA, 481 bp, Homo sapiens
ggcaccaggattgaatcctggaacctcaccatcttccctattacgtatacttctctattatgtatacatcaccatcttccctattatgtatacatcaccatcttccctattatgtatacttctgttatgtatacttcaccaccttccctattatgtatacttccctattatgtatacttcaccatcttccctattatgtatacttccctattatgtatacttcaccatcttccctattatgtatacttctctattatgtatacttctctattatgtatacttcaccatcttccctattatgtatacatcagttttcaaatattaaacccaccttacatttctaggataaaccctacattattattattattattattttcccaatatggagtcttgctctgtcacccagagctggagtgcaataatgtgatcttggctcattgcaacctctgcctcctgggttcaagcaattttcctgcct

SEQ ID NO: 10353 - DNA, 57 bp, Homo sapiens
gaatgcctacagttagcagatatggtatcctctgagcgccacaaactgtacctggta

SEQ ID NO: 10354 - DNA, 660 bp, Homo sapiens
ggcacgagggaaagtgtgggaccttttccccgaggctgacaaagtccgcaccatgctggttaggaagatccaggaagagtcactgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgct

SEQ ID NO: 10355 - DNA, 624 bp, Homo sapiens
ggcacgaggagggacgggtcccgcggcgagcgagctcctgagcataagctgtggccatgactactgaagtaggctctgtgtctgaagtgaagaaggtaaaagaaacacaggaagacaaattagaaggaggagcagcaaaaagggagaccaaggaagtgcagaccaatgagctgaaagcagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggcaccaggctcatcccagtgcctggctggcccctgcagactcaggctcaaggcctaccccagtgccaggtcagctctagtggacccaggcttca

SEQ ID NO: 10356 - DNA, 670 bp, Homo sapiens
ggcacgagagattctcctgctcagcctcccagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatgggccaggcacggtggcttacgcctgtagtcccagcactttgggaggctgaggcaggcggatcacaaggtcaagtgattg

SEQ ID NO: 10357 - DNA, 623 bp, Homo sapiens
ggcacgagggaaagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgcaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacac

SEQ ID NO: 10358 - DNA, 572 bp, Homo sapiens
ggcacgaggtggcattagggagggattgtgagaaatgacttgtaaatataccttgggaaggtaaaacaaagatgatttattgatgggaaggatggaattgatagaatgtgagggaaagggagaactcaaggggaatactctgattttttagcctgtcattggttggatggtgaagcaggcaacaaaaatgggggggcctgggcaaagattaggggggggggagccaagagtttcatttggagctcatcagtttgaaatctcagtgagacttccaaattgaataggcagttggatgcaaagatgtggagcttgggcctggagatgcacattgtttggagatataaatggtgtttatagacctatggttttataatacatcccttggagagatagagagaaaccagagccaaagaccgaacccagggtcactccaccacttggaggctgggccagtggctggaatgcacagcagcacggggcctggtgtatagtaggtgttcaacaaatctttgttgctgaggaaatcagcaccagcagtagtgactgcttatgcagtttctggagcagcttgc

SEQ ID NO: 10359 - DNA, 57 bp, Homo sapiens
gtgacaaagcagcaagacgcagtctcaaaacaaaacaacaacaacaacaaaaaaacg

SEQ ID NO: 10360 - DNA, 120 bp, Homo sapiens
ggcacgaggagagagagagagagagagagagagagagagagagagagagagagagagagcgcgcgcgcgcgctctctctctctctctctctctctctctctctctctctctctctctctc

SEQ ID NO: 10361 - DNA, 161 bp, Homo sapiens
  misc_feature 12, 161: n = A,T,C or G
gaatgtttccangccacctcggaggagaatcagatcccctcgcacttgcctgcctgcccgtcgctccagcacgtcgccagcctgcggggcagagccatcatcctgctgtacgtgcaggccttccaggagggcatgccaccccctgggtgctgcacgggccn

SEQ ID NO: 10362 - DNA, 639 bp, Homo sapiens
ggcacgaggcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcag

SEQ ID NO: 10363 - DNA, 384 bp, Homo sapiens
ggcacgagggcacatgcctgtaatttagtcactccggaggctgaggcaggagaatcgcttgaacccaggaggcggaggttgtggtgagccaagatcctgccattgcactctagcctgggcaacaagggtgaaactctctcaaaaaaaaaaaaggaaaaggaaaaggtcaaaccctgttaaaaaacaaacctctttctttcaattaaaaaaatgggccaaacgggggcccttccaattttttggatccctatataaaagttaattcccataaaaaaattccatttaagctttttaaaaaccttattttattttagagatttttttatttcaatccttataatttaaattaaccatgggcaaaaagttaaaatccatttaaaaatg

SEQ ID NO: 10364 - DNA, 384 bp, Homo sapiens
ggcacgaggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatattcccactccagggcg

SEQ ID NO: 10365 - DNA, 623 bp, Homo sapiens
ggcacgaggcgaggtcagccccaactaccggaaatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaa

SEQ ID NO: 10366 - DNA, 605 bp, Homo sapiens
cggcacgagcggtgacaccccacaaggacacggcctcagcggttccattttcccccgaacattcagccacttccctggagcaatttttcctgccccgctggggaccagcgagtggcctagttgcggctgtggccctggacagcggcgtgaggcccaaacctctaggtagggcccagttggatcctgatttttcattgagccaggcagtctcagcccgagttgaaaggcctccttagccttggaactaacgtctcttcaccctgacttctgggcaaggggagatcccaggaaaaggtttacctgcaggttttccaaggccaaagccccagcaaggaccccctctccaacctttgttatagggctacatggggcctgggctcagcatcctcatttgtggtaaactgaggcccgggacaagcccggcagagcctaaggctgctcggggagtggggccaatcagagatgattggagctgccagaaactctaatcagatgacagagacctcccccggcgggggtactcaggtgctacgaacatggcagctcttgtttccggctgagccatggccagagcagggctcagtctgcccctgaacttgctgaat

SEQ ID NO: 10367 - DNA, 91 bp, Homo sapiens
aaacctaaagacagaaataccattcgaaccagcctggggcacatggtgaaaccccatctctactaaaaatacaaaaaaattagctgggcgt

SEQ ID NO: 10368 - DNA, 403 bp, Homo sapiens
ggcaccagagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgcc

SEQ ID NO: 10369 - DNA, 404 bp, Homo sapiens
cgttgctgtcggacgggtccaccatgttagccaggctggtctcgaactcctgacctcaggtgatccacgcacctaggcctcccaaaatgttgggattataggtgtgagccaccatgcctggccgggagcagcattcttaaggaattcaagacacaggaagaacacttgcctttagtgggagcaagacaacgcagtgtggcagaagacaaagaatgggggcacaagtgcaaggtgaattggaggtagaatataggacttaactttctgacggcttctgttttctcagtgaagtctgaggcaaggccggtgacttaaacaaagaaggggtagtggataatttcaggaaagatggacacttcaccttgagcaacaggacaaggaactgagtaactgggaaacaaggt

SEQ ID NO: 10370 - DNA, 512 bp, Homo sapiens
ggcacgagagatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtc

SEQ ID NO: 10371 - DNA, 434 bp, Homo sapiens
acaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtcta

SEQ ID NO: 10372 - DNA, 290 bp, Homo sapiens
aggaaagcttaatcattggaaatgtagattattcctgctttgtggattatttgcatcagagttttaaattatgggttgatgatttttttttttttggcttttttaaccctccctttttttttttgttttccctaactcggggtgggggaaccctaagggaggcaaccggtttttaatggaagccccctttcccaccaaatttggcccagggggctttttgggtttttccaatttttggggggattggctttttggaagggctttggctacctttggaaccctttcccaaa

SEQ ID NO: 10373 - DNA, 572 bp, Homo sapiens
ggcaccaggtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaagcactgtcagttcctatgtgccccacaggaaagcgcccttaaccactgatgagtgttgatgtttttctgcact

SEQ ID NO: 10374 - DNA, 267 bp, Homo sapiens
acaggcgcgagccatcacacccagcttatatttttagaaaggtaataaggtagtaagcagaaaagtgtgaacacgaccacctgattgcttttcctgcttgaaggctgcttacaagtttagcccttggctagtgtctgcatacttacagggtttccaccattaacagaattgggtagagtagctcagtgtgcctcaactgtttgtacaaacaatatggtttatgctgaacaccgctttccctctgggagtctagacttttggtatgtg

SEQ ID NO: 10375 - DNA, 212 bp, Homo sapiens
ggcacgcaggggcatctgtgaaaaagagtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggctt

SEQ ID NO: 10376 - DNA, 461 bp, Homo sapiens
ggagccaccgtgcctggcctacataaaggatttcattgaagatttgcaaatgtctgtgggctgggctgcctcaatttgaatcctgggtccgccgcttccctgctgtgtggccttgtgcaggttacacagtctatctgtgcatcagagtcttctgctgaaaaacggagctgataaaaaaaagagagagagagaaacggagctgatgagaatgactgttgcctcagaaggcttttgtgggaatccgtgggggtaaaaatgtgtaaggtgcaaagtgccttacacagatcccactctgactgtcatctcagatgaggaaacagaagttcagagagatggccaggcatggtggctcatgcctgtaatcccagcactttgggaggccgaggcgggcggatcacgaggtcaggagattgagaccatcctggctaacacggtgaaaccccgtctctactaaaaaatac

SEQ ID NO: 10377 - DNA, 80 bp, Homo sapiens
aaataacttataaaagtgtataaaaattacatgccaggccgggcgcggtggctcacgcctgtaatcccagcactttggga

SEQ ID NO: 10378 - DNA, 412 bp, Homo sapiens
ggcacgaggtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacag

SEQ ID NO: 10379 - DNA, 237 bp, Homo sapiens
acgacagaagggtatcaaaaataccaaaaaaaaaaaaaaaaaaaaaaagggaaagaaaaaaaaatttccccggggggggggggtttcccctttttcccaaatttttcggggggggggggggggaaaaatttttaaccctgggggggggggggtccaggggcctaaaaatttgccctgggttttttgggggggcccaagggggggtttccaaaaaaaaaaaaaaaaaaaaaaaaggga

SEQ ID NO: 10380 - DNA, 482 bp, Homo sapiens
aaatgagatcataaggatgaggccctaattcagtaggactagtggctctgtaagaagagcaagagagacctgagatggtatccactggccctctcaccatgtaaatgccttccacctccatcaaaagggggccctagacctcagacttcccaagacaatgaacccaagacatttcactatgatttgtcaagagcgaagattaaagaaaaaagcaggggccaggcatggtggctcacgcctgtaatctcagcactttgggaagccgaggcaggtggatcacttgaggtcaggagttcaagaccagcctgaccaacatggagaaaccccgtctctactaaaaatacaaaattagccgggcgtagtggcgcatgcctgtaatcccagctactcaggaggctaaggcaggagaatcgcttgaacccgggaggcagaggttgcggtgagctgagatcacaccattgcactccagcctgggcaacaag

SEQ ID NO: 10381 - DNA, 198 bp, Homo sapiens
cagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgctttttttt

SEQ ID NO: 10382 - DNA, 601 bp, Homo sapiens
ccgggggctttgataggagttgtccgggaccccagggagatgagggttcagagggtggtgagggcacataggaggggagtggaagcctggctctcaggcctaggcccctatcctgccccagggcaggtccaggccctggaccccgcctagcgtaggctagtgtgtatccctggaaccagaagagagtaggtgggctctggaggcctcaaaggacccccgctagactctgtgatccccacgccccagaacatgcgtgggcgctatgaggcaagccaggacctgctgggcaccctgcggaagcagcttagcgacagcgagagtgagcggcgggccctagaggaacacctgcgtggcgccgtcggtcttgtcccgcaggcactggccaacatggcgaaaccccatctctactaaaaatttaaaaaattgcccaggcacagtggctaacgcctgtaatcccagcactttgggaggccgaggcgtgcagatcacttgaggtcaggaatttgagaccagcctggccaacatggtgaaaccccacttctaaataaaaatgcaaaaattagctgggcgtggtgataggcgcttgtatcccagctactcg

SEQ ID NO: 10383 - DNA, 627 bp, Homo sapiens
ggcacgagacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaagacctgttggtacagatttcaaacccttaaatagtacccctgcaacaactacag

SEQ ID NO: 10384 - DNA, 367 bp, Homo sapiens
gctcatgaagctgaatgtgggaagttcactttcacccatccaacccagaacatctttttacctgctctgaagatggatccctctggcactgggatgcttccacagatgtacctgaaaagtcgtcactctttcaccaaggtaaaactttttaatgaatactgttatgtgtactttttttttttttttttaaaaaaaagtttcattttttcccccaggctgaaatgcaggggcacaatttcggttaattgaaacctccccctccggggttaaagcaattttggggcctaaccctcccgagtagccgggattactatttttgccccaccggccccggttaatttttttgttttttaaggggaaagggggt

SEQ ID NO: 10385 - DNA, 596 bp, Homo sapiens
attaaacaggagcttttctaatatggctggaaactgttgggggtggattagagatttttaaggatcttatggcaagctttggctggtagagtacaagaatctagtggtgtcttttattggggttttgggggtgctgggaactatgacattacaaagagccactaattgttaactgaaggaaaaaatactggtcaatgaagggaaacttaactataaaatcaacttagtagaaataaaccattaagtggtactaatatgggcaggcacagtggctcacagctgtaattccagcacgttgggaggctgaggcaggtggatctcttaaggcgaggagttcgagaccagtctgggtaacatggtgaagcttcatctctactaaaaatacaaaaattagcagccagggctgggtgcggtggctcatgcctgtaatcccagcactttgggaggccgaggtgggcagatcacctgatgtcaggagttcgagaccaacctggccaacatagcgaaaccccagctctactaaaaacaaaaaacaatacaaaaaattagtcgggcatggtggcgtgtgcctgtagtcccagctactctggatgctg

SEQ ID NO: 10386 - DNA, 172 bp, Homo sapiens
tgtgggggtggagtggccttgcccacgcctctcacctctgccttcatttgtgctgccaccctgcccctccctcgtcctcctctcccgcttcctcctctctgtgtgcctcagtctcctgccggaagaaatgggttgagcccgaaaggaggctgtctgaggaagggagagggag

SEQ ID NO: 10387 - DNA, 345 bp, Homo sapiens
cggaaaaagaagaaggaatctttaccaatggactacaggaagtgaaagcaaaacgtttccctacctgaaagtttccttgtgtgagactggaatatatagttttacctctgtacaccatttttgctctagcctatatggactacctacactcataatgagaataatgatcaaatgaaggagttcggttttgttttgttcttttctttctttttttttttcttgaaacaatctcactccgtcacccaggctggggtgcaggggcataatctttgatcactgcaacctctgcctcccaggttaaagcaattcccctgcctcagcctcctgagtagggggaattacagg

SEQ ID NO: 10388 - DNA, 535 bp, Homo sapiens
tgtgaccttgggcaagtgacttcatttttctaagtctgttttgtcttttatgaaatgaggataataatagcactaacctcatggtcattgggaggattgagataatgctaaaagcatccttagcacagggtctggtaatttaataaaggtttaataaatattaccatatgattcttattactgtgaacagttaagaaatagtaaagtgatacataatgggtgagtacgaggcatgagaacacaggccaacgtgatgaattgccccatgaatagtgctgtgtataaccctctccaggccaggtgtcatgctcccacctgtaatcccagctctttgggaggctgaggcaggaggatcgcttgagtccaagtgtttgagaccagctttaatgaaaccccagtttctacaaaaaatacaaataaaatgaaaagctgggcgtgatgatgcatactgcactccagcctgggcaacagagcaagatcctgtctcagaaaaaacttctccagcagtttggatgaggtgagctcactttgaact

SEQ ID NO: 10389 - DNA, 559 bp, Homo sapiens
ctcatgaggaagaggaggaaaagagcattaccgctgtttgtcacatgaggattcatttgcagatagtatgaaaatggaggcaatttttccagtctcaagaatggtaaaaggcacaggtgggacttgaacccagactcttggcttcaagtccagagttttctcatgcaccagctacccctcaacaggatttgactatcctgcagtaaccctagaggaagtttagtccttgggacgcttggcctgccagtctctgaaaaaaatatgatggggatggtggtggtggtagtgcacgttgggttgaggggacagaggaagaagcaggttgatggctgttgtccatcaggtaacacagtgtttcttttcccattttctctggaatcaagaagcacccagaagactgggctgagcagaagactggagagggtgcaggaaagatggtagcaggagaggagaataaagcaccatccaggagcttagtggagagtgccccttttctctccccaactggatcagattgtgtagacagtgtgggaggtgcagctggtcaatgcttaaccga

SEQ ID NO: 10390 - DNA, 510 bp, Homo sapiens
gtaatcccagcactttgggaggccgaggcgggtggatcacctgagatagggagttcgacaccagcctgaccaacatggagaaatctcgtctctactaaaaatacaaaattagccaggtgtagtggcgcatgcctataatcccagctacttaggaggctgaggcaggagaatcacttgaacctaggaggcagaggttgcagtaagccgagattgtgccattgcactccagcctgggcaacaagagcgaaactccatctcaaaaacaaacaaacaaaaaaattgcaaaatgtagtcaccctgttatgtttcatgactctgaaagtgttatgtgtttttttaacagtaaacagtcacttcaatagtttattatttcttatcattattagtaatatcatatcaatattttaaagctgaagttgtttcttcaacccttaacttataaactaaaacccagagtaccaaagtttgctttgcagcataaaacaaattaggaggttgctctaatttagt

SEQ ID NO: 10391 - DNA, 298 bp, Homo sapiens
aaaataatcatgaaaacgatttgcggaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccacc

SEQ ID NO: 10392 - DNA, 539 bp, Homo sapiens
ccacaaaataaacattaagaacaagtcctcaactggtgaaacccctgagtttcttcaccagaagcaaatgcagagccattttgtaggaactcttccacaatcatgcccagtaaaaatgatcttgcaattttttttttaaaaaagcaaaagaccacacgagagagccattcaccaagagggagtagacacaataaattgagaattagcaccctgaaagggtgacataatataactgtgggtatcattagtgcaaacactattttcagccctttgccttctgggcacctaagattacacctcttggcccacttgagggaggagctaaatgaacaacatgtgtatgacttgtattaaaaagacaggcagcccgggcgcagtggctcacacctgtaatcccagcacttcgggaggcgaggtgggtggatcacctgaggtcaggagttcaagaccagcctgaccaacgtggtaaaaccctgtctctgctaaaaacacaaaattagccaggcgaggtggcacgtgcctgtaatcccagctactca

SEQ ID NO: 10393 - DNA, 565 bp, Homo sapiens
ccatgtaaggacacacaaagaaggcagccacctgcaagccaggaagagagccctcaccagggaccaaaatggccagtgccttgattttggacttcagcctccaggagagtaagaaataaatttctgtttcttaagccacctaatctgtgatattttgttatggccatttgaactgactcagacagccaggatcacttatttagttgttcattaatttattgatccattcaagaaattcaacaactctctattgagtgctttatgtaccaggcactgtttttggaggtcaggatgcatcagtgacagaagacaaaaagattcctacattgtaagcttacctgtagggacagtaaacaatcaacattagaagtaactaaatctgtggtgatgatactatacattttgtgatgtaccttaacagtacataaatgtcttttacacccattattgcatctgacctggcagaccccgggaggtatgaggaaatgaagcccactctccaggtcacatggctggtaccaattatagtagtagctaataagtatttagctgcttattatgtgct

SEQ ID NO: 10394 - DNA, 523 bp, Homo sapiens
gcttcacaaaaatatccaacctactgacaaaagagttgtggagtatttcatgatacaatagtggtcgttgttctgggtctgtgagacctccttgcgtcattttaccttggtcacttcaaatcctataaacaaacatttactgagatctcatgtgcagcgggcacggtgctgggggtttgttctcaaggctaaggaggtggaggagattgggcttccaaggaacaggtgaataaatagattcattgagttgtggtggttctatttcctctttccacccaaaacccatgcgggaaacatatttcctcaaagtctgtggtgtgggttttaagttttttcgtgttcttagatctaaaagaatcaggccgggcacagtggctcatgcctgtaatcctagcactttgggaggctgaggcgggcggatcacgaggtcaggagatagagagtatccttgctaacacggtgaaaccccgtctctactaaaaatacaaaaaacaaaaacaaaaatagcccggcgtggtgatgg

SEQ ID NO: 10395 - DNA, 516 bp, Homo sapiens
  misc_feature 369, 439: n = A,T,C or G
tctgaacagtttaatagtagatttaatccgtgagaggaaataccctcgaaagttactatagaaataacaccttactatctggtggcatttacttagttcttagaactgactaattagtttatcggttaaagtaatttgctattatattgtaaaatagtacatttgaggctcacttataaaaattggaaaacatcgaaatataagaggtccaagagggtgtttgaaacacattttgctaagttgacaggaaattaatagactttttatgggccattaactaataatacacttcaaaaaaaggtacagttaaataaagggtttaaatagtctataccgtatactaaaactaaattaatatttaggactganataacatattgattaagtaccagctatgtacccaaaaaatgctgggcacagaagttagagtaagatgttntacttaaagggcctttgagtgagagttgggcattcattctgaactaaccactaatatcattaagaattagtgctgag

SEQ ID NO: 10396 - DNA, 53 bp, Homo sapiens
ggcaccttaaaagccctacattggccgggcgcagtggctcacgcctgtagtcc

SEQ ID NO: 10397 - DNA, 449 bp, Homo sapiens
  misc_feature 289: n = A,T,C or G
cacatttgtttactctatgaaaactgaaataagaagacagagagtcctcttgctcaacagacctcagctggaaatacgtgtgttggacggctgaaatttttttgcctttctgctcatgtccatgaatgactgcaaaagtaccacaagtactggtttgggaattacaaataaatttcagtaagcagacaaattcacaggtatggaatctgtgaataaggaggatccactgtataaggaaactggggctcagtgaggtgaagtcacacaattagaggcaggcaggaagcanatccatgatgatcaagatccaaaacccagagcacttaactctcattattctgcactcattcactcaggaaatgttcactgacaacttcttatgtgccaagcaccagggccatagatgaatgtaatctggtcccaattcttcctgagaatgaaacagaaag

SEQ ID NO: 10398 - DNA, 439 bp, Homo sapiens
tagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggcaacctcacgtctgattcggatataaagggctgatttggcttatttatatgatttcaattcacaggcagccataatcaagtgcttactaggcttgtaagagcagccagaggtcagaccattta

SEQ ID NO: 10399 - DNA, 537 bp, Homo sapiens
cttgtgcctgtggtcccagctactcgggaggctgaggagggaggattttttgaggccacaagtttgaagctgcaatgagctataattgcaccactgcactctagcctgagtgacaggatgagaccctttctctcaaataaaggaaaaagaaaaaagtaataataacaaaataaaaagagtaatttaccaattactgagggagtctagaaaggttaagtataccccctctaaattggaaataacagtttaaaaaatattttattggtaaaaaataaaagccactttttatcctgagagagtatgtagaacttgaattttggtttaaagcacttattactaagcttaacgtaaatactttggcaaattgattctaacaaagatatccttctcatgacttaaaagagccactaattttacttttgaaatatgtttaatttttatattaaaagctaggatggctgggcgcagtggctcacgccagtaatcccaacactttgggaggcggaggtgggtgaatcacccgaggtcaggagttcg

SEQ ID NO: 10400 - DNA, 582 bp, Homo sapiens
  misc_feature 473: n = A,T,C or G
tgcaaccctatggaagatgatgtggactgcaaaaactgcattaagcagcagaatttggctcacggatatacaaattaggagccttttctattattcctcataaaacataaggaagaattaaaaggtgcctgagatactgaagtaattgaatggggaattcttaattaatcagctaattatttaaaagatcatttattcatttaagaaattaattgagcacctacattataccatgtgtattttattttattttaaaattctatttatttatttgagacagagtcttgctttgtcgcctaggcttgaatgcagtgccatgatctcagcttactgcaacctcctgagttcaagcaattcccctgcctcagccttctgagttcaagcaattctcctgcctcagcctccggagtagctgggattataggcgcctgccaccaggcctggctaatttttgtatttttagtagaggcggngtttcgccatgtgccaggctggtctggaactcctgacctcaggtgatccgcccgccccggcctcccaaagtgctgcgattacaggcatgagacgcttgcccggctgcat

SEQ ID NO: 10401 - DNA, 645 bp, Homo sapiens
attttgcacatgatcctgggagtaaagagtcacaggtaaacaaggctgcaagaaaagtccaggtggtgttcacacagtagctgcaaacttctcagaacttttcagaaattcatccttgcctgtcattacattttttaatgagccactcagcattccaacgaacaacccaatacatcatttcctctattaattggtgcagttaatttgaaaactgttctcagttctatatttatatgggaaatattaagagtccatctccttgctcctttttcattaattccacacacattcatggagcatcacgctaggaactaaggacatgatgtgacccgaggttggcaggtcctaccctcgggctcgggggcaccaagggctaggtggccatgaaagagcccaggccgggcgcggtggctcacgcctgtaatcccagcactttgggaggctgaggcgggcggatcacgaggtcaggagaccgagaccatcccgggtagcacggtgaaactccgtctctactacaaatacaaaaaactagccgggcgtggtggcggacgcctgtagtcccagctactcgtgaggctgaggcaggagaatggcgtgaacccgggaggcggagactgcagtgagttgagatcgtgccactgcact

SEQ ID NO: 10402 - DNA, 310 bp, Homo sapiens
agaatcgcttgaacctgggaggtggtggaggttgtagtgacccaggatcatgccattgtactccagcctaggtgacaagagcgaggctccatctcaaaaaaaaaaaaaaaaaaaaccaaaccctttggcttttgttggtttttgaaaaaaagtttaattttgtcccccagcctaaagggcagggccgggatgtggcctaattgaaatttgaactccgggcctaaggggatccacccacctaaccctccaaaagggctgggtttatgggcttgacccattgaccccagctggaaacctttaactttttaat

SEQ ID NO: 10403 - DNA, 253 bp, Homo sapiens
gtttgaatgtgagctctgcatttttatctgcattactttttgcaaatggcataacttttctatgtcctagtttcctccactacaaaatggaagtaaaattactttttatctcgaaaagttattacaagaattaaataagttaattattttaaagtacttagaatagtgcctggtacatagtagttgcttagtaaatatgagccataattacttctttcctgtatgtttgaaatagttcatagtaaaatattta

SEQ ID NO: 10404 - DNA, 566 bp, Homo sapiens
ttatgtcacactatatataaactagtaagaataatgactaccatctattgaatcctaaccatgtgtgaagcactgggctagtatattacatggactgtctaatttaattgtctcacaaatgctatgcatgcataggctttatttacatctccatttcatgggagtgaaaagtggtgctcaaaggctaaataacttaacagttggtaagtgttcgaactaactgggatttgaaccaatgtttgtttgtccagtatgccaatcagccaatgctaaatgtttaggtgcagtttgcattataatctttaaccacattggctgattaaataatagttcttttgttattttctataatgaatatcttattgaatcctctaaataaatttcacgtatgtataatacaaaaaatcccaagagatattgaataataaaaatattggccgggcgcggtggctcacgcctgtaatcccagcactttgggaggccgagacaggtggatcacgaggccaggagatagagaccttcctggctaacatggtgaaacctgtctttactaaaaatacaaaata

SEQ ID NO: 10405 - DNA, 507 bp, Homo sapiens
actccatctgctggaaattgtaagatgtctacaatgtgactaccatgcgctgggattataaagagaatcctggtcagagatgctaagaggcacgtggtggcaatagtgaggttcttgttagaagaacctaccagggtggttccctagttcaaagctggtcccctagtcctctcagaaatgcattagcaggctgggcgtggtggctcacatctgtaatgccagcactttgggaggcagaggcaggcagatcacttgaggtcaggagttcgagaccagcctggccaacatggtgaaacccgtttctactaaaaatacaaaaattagccgggtgtggtggcacacacctgtaatcccagctattgaggaggcggatgcagatgaattgcttgaacccaggaggcagaggttgcagtgagtcaagattatgccactgtactccagcctgtgcagtgagtcaagattatgccactgtactccagcctgggcaacagagcgatactccgtctc

SEQ ID NO: 10406 - DNA, 135 bp, Homo sapiens
tgatccgcccgcctcggcctcccaaagtgctgggattacaggcgtgagccaccgcgcccggactgtaccaacttcttaatgcctgaactgcatctctgcttggacttttactgcaaacaaatgtattatgggatg

SEQ ID NO: 10407 - DNA, 152 bp, Homo sapiens
ggcacgaggctggtgttagggttctttgtttttggggtttggcagagatgtgtttaagtgctgtggccagaagcggggggagggggtttggtggaaattttttgttatgatgtctgtgtggaaagcggctgtgcagacattcaattgttatt

SEQ ID NO: 10408 - DNA, 399 bp, Homo sapiens
attcggcacgagaggatgttgctgctgtgggccgcaagggtcttggtagcttcctctagggcaggcttgtgttcctgattggggttgggatgggtgggggcatcccctgtggcctcagcaatccagccctgcgcatatgggtcccattacacagacgtagacattgaggtctagttagaaggacttgccaggagtcctgtaatagagcttggcacttgggtctcttgactctcatggactgggtgtgagggaagtgggctccttttgctccctacctgcagtgcctttgaggggatgagggtcttccatcagagttctgaaaatgacctgcacattttagtgccttagaaatctgctcgttggggccaggtgtggtggctcacgcctgtaatcccagca

SEQ ID NO: 10409 - DNA, 517 bp, Homo sapiens
ggcacgaggagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaagccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctacttctcaagcttccctccaaagaaactgattggccctggaacctccatcccactcttgttatgactccacagtgtccagactaatttgtgcatgaactgaaataaa

SEQ ID NO: 10410 - DNA, 299 bp, Homo sapiens
cgctgggctcaggcaatccacctgccttggcctccaaagtgccgggattgcaggcataagccactgtacccggccccaactaatttttgtattttttgtagagatggggtttcaccatgtcggtcaggcttgtcttgaactcctgagctgaagcaatccacccgccttaccctcccaaaggtgctcagattacaggcttgaggcactgtgcctggccatgggtgccatctatctaaagagtgatgaacttggtgttaaaccagtaatagaaatcaccaagttcctaccatcatgagctc

SEQ ID NO: 10411 - DNA, 521 bp, Homo sapiens
ggcacgaggagacgtcgtctctacaaaaaataaaattagccaggcatgatggcctgtacctgtagtcccagctactcaggaggttgataggggaggatcacctgagcctgcgaggtcgaggttgcagcaagccaagatcatgccactgtacttcagcctgggcgatagagaccctgactcaaaacaaagaagacccagtacaagttcagtgttgagtgctaaagacttaaaagagttataaagctgaacccttaatcttaagaggtttataagtgagaacaagaatctccaaatcctgtactgtttaatatcagcatgagactaaaccactgtcctaagaagacaaccttaatttgaatcaagttattttagagtgatgtgttttctgaagcagctctcagaaggttattgtctggtgttaaaatagtgaaattgagtaataacaaggttaaaatcggtggacattaaatacacacaagacttcaattgctgggtcctccattgattaatgaaaaaatgat

SEQ ID NO: 10412 - DNA, 428 bp, Homo sapiens
gcttatcaaacgagacacagtgatgatgacatttttgaacacagattaattgtgccaccctctcttatttccttcctcattgagcatacaaatgagagaggtacaatttcaggtaactttgcaaaaaggaaagaaatagaatttctgagccgggcgccgtggctcatgcctgtaatcccagcactttgggaggccgaggtgggtggatcacctgagattgggagttcgagaccagcctgaccaacatggagaaaccccatctctactaaaaatacaaaattagccaggcatggttgtgcacgcctgtaatcctagctacttgggaggctgaggcaggagaattgcttgaacctgggaggcggaggttgtggtgagccgagatcgcaccattgcactccagcctgggcaacagagtgaaactctgtctc

SEQ ID NO: 10413 - DNA, 350 bp, Homo sapiens
  misc_feature 303, 309, 338, 340, 346: n = A,T,C or G
ctttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcttgcagtggagaggaggtctttcagccncagcangtctggagggctgataatgaacctgctanangttttnacat

SEQ ID NO: 10414 - DNA, 166 bp, Homo sapiens
  misc_feature 10, 11, 14: n = A,T,C or G
aaaaggtctnnatnaattgcaaagatgtctgacacagtctggcattgctggaggatacaaaccttttaacctggagacttgccggcttatggtttcaatgctggatagagatatgtctggcacaagggtttcaatgaatttaaagaactctgggctgtactgaatg

SEQ ID NO: 10415 - DNA, 85 bp, Homo sapiens
aaaatgtaaggattctggaatacatattccatgggactttccttccctctcctgcttcctcttttcctgctccctaacctttcgc

SEQ ID NO: 10416 - DNA, 367 bp, Homo sapiens
cgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggcctt

SEQ ID NO: 10417 - DNA, 375 bp, Homo sapiens
gcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacctaccaacagggtatagagtatagaggctatttctataattttcttatatataatttttttaacttttaatcttttttgtttcctttttttttttt

SEQ ID NO: 10418 - DNA, 499 bp, Homo sapiens
ttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcactttta

SEQ ID NO: 10419 - DNA, 411 bp, Homo sapiens
  misc_feature 411: n = A,T,C or G
cgttgctgtcggaattgaagcccaggtgggtgtccaatgccagaccatggatcatcagcctgggacaccaaagtgccacactctcagagtgaggatgatcctcaggaagtcagctctaccaccctccacaccaggaagtgcaagcagactcacctcatgattgagcagaataagagaatccttgagaagtcataagtttgcatggatttgcagcacaagttcaaacaactagatggcaccaaatccctcaatttatgaagacatttaacgtggtacccaattggaaacgcctcatggcagaaacaaacataaatcctttctagaaggttgccttgtccaagtgtttcccaaaccagtttttttagggaaaatgcacagcttactataaaaaaattttaacctaaacttggn

SEQ ID NO: 10420 - DNA, 300 bp, Homo sapiens
gcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgc

SEQ ID NO: 10421 - DNA, 397 bp, Homo sapiens
  misc_feature (1)...(397): n = A,T,C or G
ggcacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcacccgcctgtgtgtgtgcgcacacacgctccctctctctatagacagacacacactgcgcgctcgctctctcttttgtgtgcgctctccgtgctccccccctctctctcttttttctctatatnnnnnnnnnnnnnnnnntctgagagctcgcgcgctcagcgttctattcacacgcgcgttttttttatatatatattttgtgcgcgccggggggggcgcacacactctctcttttttgtgggttcgctgtccgcgtccctccttttg

SEQ ID NO: 10422 - DNA, 371 bp, Homo sapiens
ggcacgagatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctc

SEQ ID NO: 10423 - DNA, 300 bp, Homo sapiens
aattccgttgctgtcgtaaaacttaaatacattacacgggttgtaaggacaaaggattttaaaatctgagcacttaggtgaagggacaagcaggtttatgtgtttaaacagaaagaagggaaaaggtactatgtgatatggtactgaaattttgatcccaatagaattcatttctcttacgttgaatccccaatcataattaagccgtatacacagattaaattaacagaagcatttcacataaatgttggtttcagtcatcaactacccatgaattcctgcccaaggatacttaatcag

SEQ ID NO: 10424 - DNA, 120 bp, Homo sapiens
ggttttgtcctcccaaaccagagtcatatgctgctagtagaattttttatttgatcctgcgaacttttcttataggaaaaataaggcaaaggatgtgtagtgcaaccatctgataaacta

SEQ ID NO: 10425 - DNA, 420 bp, Homo sapiens
ggagaaaccctcctggcaacagaaaacaaaaataaaaaacattgaacatagaaactacatgaagaagccacaatttgattggattggtttgtagaggaatttatgtccaggacgttgttgataataatagagcaatcccagattgttaatggagtttaataactgtgtgtgtgtagggaacatgggaagagagccttataagtcccagtgcggccatggcataccctaaactgctcccccctagattttactaaactaaagtaatccagccagtcactaaagaaataaacaagcggccgggtacagtggctcactcctgtaatcccagcactttaggaggctgaggcgggcggatcatgaggtcaggagatcgagaccatcctggctaacacggtgaaaccccatctctactaaaaatac

SEQ ID NO: 10426 - DNA, 65 bp, Homo sapiens
attaccaacctaacaccacacctagagaaactagcaaaccaacctccagactagcggaagacaag

SEQ ID NO: 10427 - DNA, 573 bp, Homo sapiens
catgccaccacacctggctcttatttctacttttgaattataagcttgaggacacagccataccttccatttctctgagtcactcttagaattgaacacagtattttatgcacagataaattcaataagcaactgattatttcatataaacatagagtattaaatgtctgaaaagtgttacatgtgtataacaaacatgcttcaaagcttaaatagcaatatgggatctaagagttaagctctcttattacataggtaactgaattctgattttaccagataaaagggtaaagaaaatactggccaggcgcggtggctcacgcctgtaatcccagcactttgtgaggccaaggcagggagatcacgaggtcaggagattgagaccatcctgaccaacactgtgaaaccccgtctctactaaaaatacaaaaattagctcagtgtggtggcacatgcctgtagtcccagctactcaggaggctgaggcaggagaatcgctggaacctgggaggcggaggttgcagtgagccgagattgcgccactgcactccagcctggtgacagagcgagact

SEQ ID NO: 10428 - DNA, 442 bp, Homo sapiens
atatttgtttatacttagcagtcaacaaagtaactcatgggtaaaaattggtttacaaatcttcactttaaaatgaccgtcttatgaattatcattggatttgtaaaagttactgactttaagataagatgataatgctgtgagaatgatggaaaaactatttgtgactcatgttgtattttagcagtttagataaaaataaaataaatcattcttagatgcagtcctcctatacttggaaaagcatatatttgaataagtatataaaactgaaggcttgagtgtttcagttgggtttcccagaaagcaaattctaagctaaaaaataatatataagaagtattctagtcttctttggatcaaaacctgttgtagcaataaaaggaaaaagattggctagagagagaaaatgaacatctgctgaccccactgggagtgctga

SEQ ID NO: 10429 - DNA, 439 bp, Homo sapiens
atactcttttgggggttgtgggagagcacttttagttgaatggtgaagatagaaataattaactttgaagatcttaagcaaattacttaatctctatctcattttactcctttaactacattctggcacatcttttcaacacatatccacacttacccactccaagagaaaatactgagctctgcctggaaaccattctatgcattttggagaccacaacctttattgcagcacaggcactggcagtgaaggaaatgttatgttcctgggatgatcccaggagaaaagtaaaaggtttatggacttcattacagtttccaaatgtttgaatgctttacttttccagagaaactgggcaggcaggaaagagttgcacggactgtgtcttgagtcatgaagctttgccagtgtggaggagtgtaagcctacctcttacctt

SEQ ID NO: 10430 - DNA, 512 bp, Homo sapiens
tatcttctttagaaagtccctcttatgaacaacattcctcttgtggagagtggctgaataaaatcctaaatgtaaagatcccaaactggtaacttttcatctggaagttagcaagaatgccacctcagcagctgtaaggaggaaatacccttacagagatgaggatgcactgcccttgtcatctcagactattagagggctgatgctgaactactggactcatacaatgaggatcaattccttctcctcttgattttccttctagtaagagctacagaatatgccttaatgttcatactcttagaagctacttgtttatttcaaaactccccatattttccacttctagacatggataagaagttttcttgcagttcatgaaatcataaaccatgaccatttagaaatctggctcagttcttttgctttacagataagaaaactggacaggacgtggtggctcaatcctgtaatcccagtacttcgggaagctgaggcaggtgaatcacctg

SEQ ID NO: 10431 - DNA, 516 bp, Homo sapiens
ggcacgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagt

SEQ ID NO: 10432 - DNA, 419 bp, Homo sapiens
ggcacgaggacaggccttctgaagcagagggaagcctatcagagtaagctcaggtgggcctggtcagcctcgccgagctctcatttccactctgcccacagccacagagggaatgggttgcctggagaggtagcgagtgctgcatcagtgcaggtattctcgcacagattcgacaactgcgtatcagcctgtaggtgagggaatagttaggcttgatcatccagaaagttccttttgaccctaaaagtctgattcttgtgattctagcctttggcaaaccacagataaccagtctctcctcctatagtatagggttcttattacgattattgaccttgtgatgacaagggtcacaaatccaggaggctgtgaagcccctgaaattattacttttttcttcctttttttttttttttggg

SEQ ID NO: 10433 - DNA, 70 bp, Homo sapiens
gttgagttgctcatggccctttggacctggcaagtgtctgaaccatacctctggttctatcatcatgctc

SEQ ID NO: 10434 - DNA, 470 bp, Homo sapiens
agccctcccgaccaccatagctgagagcccaggacaccatctcacaccacacgctgaatgggggtgggagccagacctggtgatccccaggactatggagcagcagggatgaggtggtggaggggaagaattgaggctgaaataagatgggagtctccttcctcacacaggctcacctctgtggcacacagtccaggagagatggtttcttcactggtctataagaacctctggtcaggccgggcacagtggctcacacatgtaatcctagcactttgggaggccaaggcagggggtatcacctgaggtcaggcgttcgagaccagcctggccaacatggtgaaaccccatctctactacaaatataaaaattagctgggcgtggtggcatgcacctataatcctagctactcagggggctgagatgggagaatcacttgaaccgtggaggtggaggctgcagtgagccg

SEQ ID NO: 10435 - DNA, 578 bp, Homo sapiens
acataattcatcaaaaaataaaaaatattatacttagcacagtatgagccttaatacaataaaaaatcctcctacagacctagtctagttgttgtcaaattttactttaaaattacttcactatggcaatactgtcttctgcaaacacaagctagctttgaatctatgagatacaattatttacatagtcaaaataaaggtgctatcttgttttaattatacatagaaagagctttttaagactcatacaaacttatctaaaagtaatatttgcaaagaaagacctagtgaggaaaaaacaaaaattacttgaagttattcagcaataataaaggaaactcaagaataataaatacatttgttttgagctaaaataaacactgttaaaaaggacgactgtgccagccgggcgcagtggctcatgcctgtaatcccagcactttgggaggccgaggtgggtggatcatgaggtcaggagttcaagaccagcccgaccaacatggtgaaacctcgtctctattgaaaatacaaaaattagccaggcattggtggtgagtgcctgttatcccagctactca

SEQ ID NO: 10436 - DNA, 331 bp, Homo sapiens
ttgtagaccacagctagacaagtgggtgctacaatcactgtgtcaagtatagaaaggacagctgagatcacatcgaggattccagaaagaattggcacaggatcatttgggacgcatctctcccttgcccctgttcctggctttccttacagctctcgacttcctcaaaggagtcatcaattcggagtttggcttccattcctattgaggaagctggaaagcgtttcaaaaatgctcctctgatgtgcctgtggttaagacctctgagctctgcttaaaactttttgaagctgggcgcggtggctcacgcgtgtaatcccagccctttggg

SEQ ID NO: 10437 - DNA, 464 bp, Homo sapiens
ttgggagcaacccctggaagatagaaaaggcaagaaaactgattaatcctgagagcctccagatggaatgctgctgtgctaacaccttgattttagcccactgaaactgattttagacttgtctactctagaactggaagagaataaatttgtgttgctctaagtcactaaatttgtggtaattcgttacaacagcagtaggaaacaaactcaggaaccaacatgagcatgaagcatatgtggcctgctgtgctgtaatgaagatttttgtctctgacccaagactcttgtgtcttctggcagcatccatgagactatggcaagctgatttgcagaaggggcaaaatcttggaccattcacagttcttaacatttagttcataaaaatgatgatatagtcatgggtatttgtctgacgtttaagtatctttcaatcttctgatcaataaatctacttctaaata

SEQ ID NO: 10438 - DNA, 460 bp, Homo sapiens
ttgatacatttgaccctgggccttctgttaaccagtgctccctatatctacagcaatttatttgtctttaattcatacaggcaatattcttagcattgttttgtggtttaaagttagtctttaacacttttcaaatagcactcagaagagtagctttctacaagagagctcatggcctgtctgacttcctaaatataataactcatagatactagagttaatgcctatttgattttttactctattcttttacactatgtgtgtgaattagcttttgttgttggtggtggtggtggttgcttctttttttaacactcaaaaataatagtttttggttaaaattttaatttcaacgttttggggacagttgggaaaatctgatataataatcttacttccatggtgttatcattaggatcaaaagaaattataggctgggcgtggtggctcatgcctgtaa

SEQ ID NO: 10439 - DNA, 532 bp, Homo sapiens
tacggctccgagaagaccacagaagggccgggtcccagagggctgaaattgaggcatctaccaggttgcgttcctttctgccggttctggggaagaattggcttccaagctccacttgttggcagaattccgatccttgcggctgtgggactgaggtccccatgtcctcgctggctggctgtaagccaggtcctctcacggctcctagaggccgtccaccttccttgccatggggctccctccatcttcaagtcaacaacagaggatttctcatgtgctgaatcccccacatgcttcaaatccctgacttcctcctcttctaccagcagaaaactactttgaataggctcatgtggttagggcaaggctcacactcaaatactttccctatcttcaggtcagcttgctataagacagaacccaaccatgggcataaaatccctttgagaagccgggcgcagtggctcacgtctgtaatcccagcactttgggaggccgaggcaggcggatcacctgagaccgggagttcgag

SEQ ID NO: 10440 - DNA, 408 bp, Homo sapiens
tgatgttatgctatggaagctaagcagcagaacctgggcagacagccatggacacatggatggctcctcctaccatatttgcttgaagtaaatgagattcagatctgagcctcagaggaatttcaaattgcaccctgccatggacctttagcctcttaccttccccaactcccccctctccacccaccaacaaatccattaaggtaaaatatctatagtgtttttaactgttcaaaatagttttcttcaaatgtgccaagagggcatttgcttaggcagattaagaaatgggccaggcatggtgactgacgcctgtaatcccaacactttgggaggtcgaggtgggcagatcacgaggtcaggagatcaagatcatcctggccaacgtggtgaaaccctgtctctact

SEQ ID NO: 10441 - DNA, 327 bp, Homo sapiens
ccattaaagatttaggttaagacagtgtaaacaaatgacttattataatgcaaatattccagagtttcccattcaataaaagatactcatgaaatatataattatgatttataattatgaataatttattgaatatctaaattatttattgcatagatattaatgcttagtaataataagcatttctatttcctcctgtgtaataggcactgtgatagatattttatataaattatctttaaccattccaactctacaagatagatgttatcacctccactttataaataaggaaactgaagcccaaagaagttaaatcacctgcat

SEQ ID NO: 10442 - DNA, 555 bp, Homo sapiens
tatttagtgggatcctcccagtcctacggtaccagcttgcattgtgaaggaaaatgaaggacagaataaagcccttctcccagtctggtttatttctgtacacagaacctctgaaaacaggaggccaaggctgacctctttagtcaagagtcagctcaactttaaaattataattgcatgtgaaagctaaaatgggaaagagaaaaaatcagttctcaggaccgaaatgctaaaaacccttgggtcacattccagttagggtcctggccgtgcacacagagctcccattgggggaaggtgggcaagagaccagccaagaccaattcaaactatagggtgttggggatcatggcatttattctagaagtgtccagtttacagataaaggaatgtactatagtgataatgctatataatcttttaaaaaatagaagcttatggtcagatctcattattgagaaaggtgccaaagaatctacccactccaagtgaactatttgcagtaaagaaatcagaggaggctgggtgcggtggcttacgcctgtaatcccagca

SEQ ID NO: 10443 - DNA, 563 bp, Homo sapiens
agattgctactggagttgagggtcttatgtagaaaacatgcttgtatttttggaagcctgcatatcttctcagagcaagagaacatgaaatggtagtatcagtagaaccacaggaaaaggacaaaaggaaagtgctcaactctttccacaatccaagtttattttctgtgagagagatgggatggggagatcatctgctgacctgggatgggctctctctttggaagccaggctctgtgctctagggaccccatgaattcctcaggaagtttccttgtggttgacatgctggaaaacaggccctgagagtttaggatgagccttcctagatgctgttttaggaggatcctataggaggctgggctctgagtatgttgagagactgaacatatgtggcacggattcacaggtctctagggagctaaagcaccctcccctacacaactcagcctgctgacccagctcacacagtttatttatagaactcactggcatgtatccagggcatgcttaaagtgtaaagtcctggccgggcgtgatggctcatgcctgtaatcccagca

SEQ ID NO: 10444 - DNA, 444 bp, Homo sapiens
atggaggcccagcactcccctagtatagctttaaaaggcaacacaaagcttattatggttgtggcttatccagactcccacccaagtacagcaagtaacaggcagtgactcaatgtccatttaaaaaaatctgagtcttgggccggccatggtggctcatgccggtaatcccagcactttgggaggtcgagatgggcggatcacgaggtcaggagtttgagaccagcctggccgacatagtgaaaccctgtctcaactaaaaatacaaaaaattagctgggcatggtggtgggtgcctgcaatcccagctacttgggaggctgaggcaggagaatggcttgaacctgggaggcagaggttgtagtgagccgagatcgcaccactgcactccagcctggatgacagagcaagactccatctcaaaaaaaaaaaaaaaaaaaaaaa

SEQ ID NO: 10445 - DNA, 309 bp, Homo sapiens
ttcttatttgtactccagtttatgaatgaattatctattccactgttttaatctgttattaatcctatcccatgaattttttaactggggtaatggaatttttttattttatttttattttttatttttttattttattttttttgggacagagtctcgctctgttgcccaggctggagggcagtggcagtctcggctcactgcaagctccgcctcccaggttcttgccattctccagcctcagcctcccaagtacctgggactataggtgcccaccacaatacccagctaattttttgtatttttagt

SEQ ID NO: 10446 - DNA, 511 bp, Homo sapiens
tgctgatatcgcaccactgcgctccaacgtggtcgacagaacaagactcgtctcaaaaaaaaattaaattaaaaagttgtaccttattataataaagacaatagaaagggaggaatctaggagaataagttgttgtaagggtgaacaaggttcataaaacacacacgcacacaccctgtggtggttgtgaggactggtgtggtacaacagaggaagagaaggcagggagaccagagttgaaggctattgcatgttgtccacgttttaatctcttaggcagaaaagggcaaagacatgcccttttcattgtcaccagctttacttttaccttttaaaagtaaattgttggctgggcgtggtggctcacgcctgtaatcccagcactttgggaggccaaggagttcaagaccgcctggccaacatggcaaaaccccatctctactaaaaatacaaaaagtatccatatgtggtggcgggcacctgtaatcccagctactcgggaggctgaggc

SEQ ID NO: 10447 - DNA, 277 bp, Homo sapiens
cagaccttctgccaccttccattccctggattaaagttcctcttttgtaaatactcaagtgtttcctggttagacactgacccatacacttccctaccaggccacaagcttcctgttgggaagggccctgccttgtatccccagggcttggatacagagaagctgcccaaaggttaatgaatgaatgaatgtcttttgattacatggcttgtctagccagattctactctcatttagcaaaagagaagaggcataagggaatgaattgctccctggg

SEQ ID NO: 10448 - DNA, 280 bp, Homo sapiens
gagcgctttatgtattgaggggattagctttgtatttgtaatatgagttgcaaatgttttcccctaccttgtttttctggattataagaaattcttggccgggtgtggtggctcacacctgtaatcccagcactttgggaggccgagacgggtggatcacgaggtcgggagatcgagaccatcctggctaacacggtgaaaccccgtatctactaaaaaatataaaaaattaaccgggcgtggtggcgggcgcctgtagtcccagctactctggaggctg

SEQ ID NO: 10449 - DNA, 175 bp, Homo sapiens
acagaagggttcataagaatgcatggttcttaaggtataaacataggatactcagttttgctttgactgtttttatttttctgtggtagggataaattgcaaattgttttggacactatctcttaacccattcccgtgagcaaagcacatttttctgtaagatgactaagctaat

SEQ ID NO: 10450 - DNA, 317 bp, Homo sapiens
gtagagacagggtttcaccatcttgtccaggccggtcttgaactcctgacctcatgatctgcccacattgacctctcaaagtgctgggattacaggcgtgagccactggctgcaagctggtttttctgtgtacttcacttatgcgtgtctattgaacacctactatagctccatgcaaggcattggaaacacgtatagaacagacgtacttcatgtccttgacatgaagaattgaaaaggttagagaaaagtgtattaataggagaaaagagtttctgaagtggacagtaccatctaagaagaaaaattggaagtaa

SEQ ID NO: 10451 - DNA, 366 bp, Homo sapiens
tttcagactggagttctgtcagtagagaactcttaacagttaagatcatcaaaggtaaaatgagctgctgcagaactccctgagcttcccactctcagaggtgctcccggaggggtagaacccatagaccatttgatggaaaatctgtataacagatttttagatggtgagagtcaggaattcaaatttctggcacttacaaagatattcttctactttaagaacattaggcggccgggcgcggtggctcacgcctgtaatcccagcactttgggaggccggggcgggtggatcatgaggtcaagaaatcgagaccatcctggctaacaaggtgaaaccccgtctctactaaaaatacaaaaaatt

SEQ ID NO: 10452 - DNA, 434 bp, Homo sapiens
tacagtggcagtgaggagagcgagcactggcctgaacacggtcgtcatggggaccctgccctacacaccctgaggccagtaaccgctaaggagagtgggcacagggcacgtgttcaggaggcccggggaacctaacagccatggcctgtcctgaggccatctttgccttcatgtgcctggggtggccctcaggtttccctgaggagctggaaacggtcttcaggctgacctgcaccacccctgtcccagcctcctcctctgagcgtcagtgtcctccctgggagcacgaggacaacgtcagccctgaaaggccacagtacacagtaagacgtgaatgatgtttccctggcctggccagtgcctggctcagccgcgtagccactggtgtctggtattcctgaagaagtggaaggaaatccttggcagattaaaaa

SEQ ID NO: 10453 - DNA, 453 bp, Homo sapiens
gtttctttgttctaggaccccagattagcctctgttaactttgtatgcgtgtgttggtgtgtaggggggttagtaagcaaactatatttgaagaataatgagaagaataaaagctgctaacctgtttctctttctccaaaaacaacgccataacatctggtgtgtgtagaaaaaagatggcgggccgggcgcagtggctcacacctgtaatcccagcactttgggaggccgaggtgggcggatcacctgaggtcaggagttcaagaccagcctggccaacatgatgaaaccctgtctctactaaaaatacaaaaaattagccgggtgtggtggcatgtgcctgtagtcccagctactcgggaggctgaggcaaaagaatcgcttgaaatcgggaggcggaggttgcagtgagccagcactgtgccactgcactctagtctcagcaacaagagc

SEQ ID NO: 10454 - DNA, 409 bp, Homo sapiens
ttggacaaatgaaaacacaaccataccaaaacctatggaatgcagcaaaggcagtggttaaaatgaaatttatttatttatttctctttttttgaaatgcagttttggtcttgttgcccaggctggagtgcaatggcacaatcttggctcactgccacctctgcctcctgagttccattgattctcctgcctcaacctcccaagtagctgggactacaggcacacgccatcacgcctggctaattttgtatttttagtagagatggggtttcaccatgttgcccaggctgctctcaaactcctgacctcaggtgatccactcatctcggcctcccaaagcactgggattacaggcgtgagccactgtgcccggccagaatgatatttatagctgcaaacacatgcaatt

SEQ ID NO: 10455 - DNA, 418 bp, Homo sapiens
tccttccaggtcaatggcctccccagttgcaggagaatggcttttctgcgaagaggagaaaatgatgcactcccaatagtacctcggactcacagccttcccagggagggataaagaaatagaaatgagaataactaaaaattatgaacaattattccctaaactagcacacgtaagtaagaatgataaaataacatgtttgtaaacatggaggcatgtttgtacattctcagtaacattaatgtttctgagaggaagtctagcactatataaagtaaaactgtttatgtcatttgaactgtattgcacgtacaaaaaaaaaattaaaagaaaatcccaaaagaaagttatgtataacttattaaagaaaaaattaaaactgcaatgtccaatattaaagaaatgctgacttggcatg

SEQ ID NO: 10456 - DNA, 457 bp, Homo sapiens
attatccctaagaatatgtaaacgaggtcaaaccccgatcctatttgcattcccctccccacgggtaactatcttgaatcagagccaatactacactattgcattagggtataatttaatcattaggggatagttttcatgcagaaactagaaagcactgatgagattctactcatgttcctttaccagctttagttataaaggggaagcgggaaaatggaagcacgtagaggataaggtgataacctccaccttaccatcttccttcttcccccttaaaaaagaaatggaatgttgagtctatctggaatgttgacaggttaaaaaggagctgttgaagcctgtcgttcacagtagcatcgaaaggtgaaaatttgtctccacttgagtaccttgaaatggcaggtgtgttattggaatattgggctattgttggtcagtactgctgagtatagac

SEQ ID NO: 10457 - DNA, 626 bp, Homo sapiens
ccttttctggcatagtagttttaaagcagaaaatacacctagttagtgttgcctataatatacatacttccttgccttgttaaggtcattttaaaagttactgcacaagccatattgtgattaaaaaaaaatcggcctggtctcaatcatccattaagaaaaatctactattaaatattccaatacagaaatttcttttaaagagcgtaatttttagttttctggtctctttctacaatgtacttgcctccctagtacctgcctcaatttccgacatggtttttagaagaaaaccacttctaatctcctcttagctgagaagccaaataatcttattaagaaatatatgttggccgggcacggtggctcacacctgtaatcccagcactttgggaggccgaggcaggcggatcacgaggtcaggagatcgagaccatcctagctaacatggtgaaaccccgtctctactaaaaatacaaaaaattagccgggcatggtggcgggcgcctgtagtcccagctactcgggaggctgaggcaggagaatgtcgtgaacccgggaggcggagcttgcagtgagcggagatcacgccactgacttccagcctggacaagcgacagagcaag

SEQ ID NO: 10458 - DNA, 390 bp, Homo sapiens
gggtggggagaggaacaaggcaaggctggacggacagcagggaccaggtgggaaacaaggcagacactgaagacagcatctgtgaggtgaggcctggacactggcgtaagagatcagagtaggctgtggacgatgttaaatgacttgacggtggtcaattagatggagagggcaagaaccttgaaggtcctgacacttgttgaatggaacttaagtattctcaggagtgatcaaattggagactggacatcaaaaactatacctgatattaaaaacagcaacaaaaggcttagctcacacttgtaatcccagcactttgggaggccgaggtggacagatcacgaggtcaggagatcgagaccatcctggctaacacagtgaaaccccgtc

SEQ ID NO: 10459 - DNA, 591 bp, Homo sapiens
ggcacgaggccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggata

SEQ ID NO: 10460 - DNA, 120 bp, Homo sapiens
gccccaggaggaaaggagcacaattggtgttcttttgtttatgaacatcagctattataaagaaacctgcatttaccattttctgcatgtcttttggtgagcttatggacagcttgtttt

SEQ ID NO: 10461 - DNA, 576 bp, Homo sapiens
ggcacgagcccttatacaaacatatatgaacatatatactttttttgttgtataaaaacaggatcacattatagatattattctgtaactttctgttttcacccaaaatacagcagagcactattttccagaagcacgtagttctaacttattctttctgatggctgtataatattccataaaatggatatgccaaactttattcaagtacttcacattttaagtggacattccatttgtctgctataatttacaattatagcaatactttgagaaaggtctttgcaagtatatccatatgaactaatgtctatgtagaagatatgctggctcaaatattatgtacatttaatgtcttaataaacaccgctagattactttccaggaagcatgcagccatgcactctctcacctacccccatcttcatttgacagcttattttcccacatcttatcagcattggacactattcatcttttcaatttttgccaaactgatgtgtgaaacaagagggtatctcattgtggtttatgttcattacactatgagctggataactttttggttattggcta

SEQ ID NO: 10462 - DNA, 246 bp, Homo sapiens
ttttttttttttttttttttttttgtttttttttttttttttttttttttttttaaaaaaagaaaaaaatttttgtaaccccccccccaaaaaaaaaaaaaagaagggagccccccgcccccaaaaaaaaaaagatttgggggggggggaaaaaaaaaaaaaaccctctaaaagaggggggggacaaaaaaaaagggggggagcaaacatttcggaggatagaggggggggggggggggcaaaaaa

SEQ ID NO: 10463 - DNA, 266 bp, Homo sapiens
ggcacgaggtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccacatgtgccctgctttgggacctgtgatgaccttgctg

SEQ ID NO: 10464 - DNA, 64 bp, Homo sapiens
gggtggaaagggagggatgaattggggtgatagaaccctggtgaattcagagtaatctttcttt

SEQ ID NO: 10465 - DNA, 64 bp, Homo sapiens
gacaggcagagctccaggctggcaccatggtaggcctccagggaaagagctgggaggcaggaat

SEQ ID NO: 10466 - DNA, 556 bp, Homo sapiens
ggcacgaggaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaagagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacagaagaatatcctggggccgggcatggtggctcacgcctgtaatcccagcactttgggaggccgaggcaggtggatcataggtcaaaagatcgagaccatcctggccaatatggtgaaacctcgtctctactaaaaatacaaaaattagctgggcgtggtggcacgtgcctgtagtcccagctactcgggaggctgaggcaggagaatcgcttg

SEQ ID NO: 10467 - DNA, 70 bp, Homo sapiens
tttacatagacacaggtgataatgtatctatgtaaatgccttttgattctgcaactgcaggatactctca

SEQ ID NO: 10468 - DNA, 371 bp, Homo sapiens
ggcaccaggggaggctgaggcgggtggatcacctgaggtcaggagttcaagaccagcctgaccaacatggagaaaccctgtctctactaaaaatacaaaattagccaggcatggtggtgcatgcctgcaatcccagctacttaggaggctgaggcaggagaatcgcttgaacccgggaggtggaagttgaggcgagcaaagatcgtgccattgtactccagcctgggcaacaagagcgaaactccatcttatttaaaactggaggagctcaaggcgcccggccttcacaaaaaagtggggcggactatccggaattccgaacatgaaaaagaccttggagaagttggcgcaaacccttcttgatatcgtgg

SEQ ID NO: 10469 - DNA, 390 bp, Homo sapiens
tgcacgaggagagagagagagagagagagagagagagagagagagagagagagagagagagagagagagagagagagagagagagagagagtgagagagagcgtgagagagagagagagagagagagagagagagtgagagagagagagagagagagagagagcgcgcgcgcgctctttctctctctcttttttgtgtgcccacttacccacatatatatatgcccgcccacacggggtgtgtgttcttgagagagatatttttttctctctaccccctggagagcgcgtgtttttccccccccggggtggtggtctcttctctcttgagggggctgttatctaacctctcctctcccctttttttctcttttctcccacacaccgtggt

SEQ ID NO: 10470 - DNA, 599 bp, Homo sapiens
ggcacgagactctatctaaatggtaaccacctgaccaaattaagtaaaggcatgttccttggtctccataatcttgaatacttatatcttgaatacaatgccattaaggaaatactgccaggaacctttaatccaatgcctaaacttaaagtcctgtatttaaataacaacctcctccaagttttaccaccacatattttttcaggggttcctctaactaaggtaaatcttaaaacaaaccagtttacccatctacctgtaagtaatattttggatgatcttgatttactaacccagattgaccttgaggataacccctgggactgctcctgtgacctggttggactgcagcaatggatacaaaagttaagcaagaacacagtgacagatgacatcctctgcacttcccccgggcatctcgacaaaaaggaattgaaagccctaaatagtgaaattctctgtccaggtttagtaaataacccatccatgccaacacagactagttaccttatggtcaccactcctgcaacaacaacaaatacggctgatactattttacgatctcttacggacgctgtgccactgtctgttctaatatt

SEQ ID NO: 10471 - DNA, 389 bp, Homo sapiens
  misc_feature 36, 37, 38: n = A,T,C or G
ggcacgaggagagagagaactagtctcgagagcagnnntttttttttttttttttttttttttttttttttcccccccccaaacttttttttggggcctaaaaagggggccccggggaaaatttttttttcccccaattttgggccccccgaaaaaaaaaaaattttgaaaatgaacagggggaacccccccgggttttcaaggggtccccccctttcaaaggcccgcgggggtgggcctaataaaaaaagggcgggccctttcggtgaacttttcaagcccttccccccccccgggggggcaataaaaaaaaacctctcccaccccaagggggggggggggattttttttttttgggttccccaagagcctttgaagaggggctgccc

SEQ ID NO: 10472 - DNA, 543 bp, Homo sapiens
ggcacgagggtacacctgtcccatactggtgtccacagagcagccatcttagctggcaggtgtccagtgcctcccccaccccccaccatgtgcttgagtgcacacccggcgccaagccctgatcctgtcacttcttgtgaatcacaccgagtcatacccatgactaccattgcacagcggggaaactgagtctagaaaggcgaactaacatgtctaaagtcatgcgaagggaataagctgacgacatggagccagttgccctgtgacaggagacctgaaaagtactcactgctgggggtagaccggacctcaccagcttcctggagagtcacatgtttgactgcatcctcagggggctcgccggcactccagcccggactgctgccagaagctttctggaggtggcagttgtcttaaaaggcaccattccagagcgcaagcccatgatgggcgcagaaaattctggacataccacgtagaggtgggctcccgaacatgtgcggacggcaccaagccgcccaaggcatcgctgtcacctgagct

SEQ ID NO: 10473 - DNA, 325 bp, Homo sapiens
ggcacgagcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaattttttttgacccatcaaaatttttaaaaaaaagggaaacctttttttttgggaacccttttttgttgggaaaatttccaagggccctagggggacccaaaaggggggggggcctttttgggggttgggggggggggggcccctaaaaaccttaaacaccctaaaacccgggggggg

SEQ ID NO: 10474 - DNA, 537 bp, Homo sapiens
ggcacgaggaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcg

SEQ ID NO: 10475 - DNA, 578 bp, Homo sapiens
ggcacgagccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaa

SEQ ID NO: 10476 - DNA, 552 bp, Homo sapiens
ggcacgagctctcccgggcttagaaggcccggctactgacgcgcagtgccagaccttagccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagct

SEQ ID NO: 10477 - DNA, 353 bp, Homo sapiens
ggcacgagaatcgcttgagcctgggagatagaggttgcggtgagtgaagatcacactgctacactccagcctgggtgagagagtgagactctgtctcaaacaacaacaacaacaacaacaacaaccacaaaacaaacaaaaacccctgattcctggagatcctgattccataggtgtggtctctgcaagcaattttatctggaattgaagaccactggtgttctgggacaaaggttttgaaacagacaggggtccaaattctggctctaccacttattgaggtgtataaatttgaggaagttactaaatgctctgaacttcagtttctcctggaaaatgggataattatgtct

SEQ ID NO: 10478 - DNA, 311 bp, Homo sapiens
taaagacagaaagttacagagttgtggggaaaacatccactcttttaatagagaggactcagttttcttaagtaatgaaagacctgataaaacacaagatcaagtacaggaaattattttgataaaacacaaaatctttctttggcagattacttaaaaggtgaagaaaaacctcttataatttttttccttccgtccttccttccctcctcctccttcctgctccctccctctcttcctttccttttctttttcctttcctttccctctctttctctttctttctttctttcctttttttttttggacaa

SEQ ID NO: 10479 - DNA, 450 bp, Homo sapiens
tcatgaaattccagtcattttacttttattaacatgcagctagaaccatgctagtgaataacttagatattagatactgtgcagccatattcaggcaggtcttaaatataactggatgcttgaaactttatctgagtcttcctaaaagtatctgggaagttaaggagaacgtttttgttggctggaagccatccttcctcatacaactaaatgatatttaatttaaaatatgaactttaccttaaatattaattagaacctaaaattaaaatattggccaggcgcggtggctcatgcctgtaatcccagcactttgggagcccgaggcgggtagatcatgaggtcaggagatcgagaccatcctggctaacatggtgaaaccctgtctctactaaaaatacaaaaaattagccgggcatagtggcgggcgcctgtaatcccagctactct

SEQ ID NO: 10480 - DNA, 571 bp, Homo sapiens
ggcacgaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgt

SEQ ID NO: 10481 - DNA, 463 bp, Homo sapiens
  misc_feature 365: n = A,T,C or G
acgacagaagggtacggctgcgagaagacgacagaagggtacggctgcgagaagacgacagaagggtacggctgcgagaagacgacagaagggtactgctgcgagaagacgacagaagggtacggctgcgagaagacgacagaagggtactgctgcgagaagacgacagaagggtacggctgcgagaagacgacagaagggtactgctgcgagaagacgacagaagggtacggctgcgagacgacgactaaagggtaccgctgcgagagacgacataagggacggctgcgagagagacatatgggacggctgcgagaagagacataatggtacggttggagaagacacataatgggatacctgangcagggagttcagaacagcttgccacatagtaaaccctgtcttctaaaatacaaattacgagggtgtgcgcaccctgtatccactcttggaggtagga

SEQ ID NO: 10482 - DNA, 605 bp, Homo sapiens
  misc_feature 559: n = A,T,C or G
ccgcctcctgggttcaggccattctgctgcctcagcctcccgagtagctgggactacaggcgcctgcaaccacgcacggctaattttttgtatttttagtagagacggggtttcaccatgttggtcaggatggtctcgatctcatgaccttgtgatctgcccgcctcggcctcccaaagtgctgggattacaggcgtgagccaccgcgcccacctaaaacatttcaaaataagatacgcaagctctatgtggaagcgaaagggggaggcgtgggagtgtcgatctacaaaaagagttttatgaagtgaaatgggtatatctcaaactgggttggatggatgcacaggctcatgcctgtcatctttgttatttggaagcgcgggccgggcggaaacttgtttttttttttttaaaacacaaaaaaatgtttttggaaccctttttttttgggaggggtgaggttttttggttcttttgccactcctttgggggagaaacctctaccccaccccccccctatttttttttccagccccgcggaacgcgcggatggtggttntttttattaaaaaaagaggggggggcgccgcgctgcctcaccccca

SEQ ID NO: 10483 - DNA, 462 bp, Homo sapiens
acgacagaagggtacggctgcgagaagacgacagaagggtacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgagaagacgacagaagggtacggctgctagaagacgacagaatggtaccgctgcgagaagaccacagaaggaaccggttgaagaagaccacagaaggtggggcaaaaaagacttttttcttttcttttctttctttttttttttttagaaggggggttatttttggccccgggtggagggaaaacatgattgggctcattgaactttgcccccggtaaggaatcttccccctacccccccaggggggctcggaaaaaaaaaataaaaaaaaaggggggt

SEQ ID NO: 10484 - DNA, 438 bp, Homo sapiens
cgctcgctgtcgaaagcttttacgggattattttcagtgtactactggactccaaatacagacatcatgagatgtccacttgcccacgtgtggacacacaggcaggagcggcccagatcctcccttgtctgtggcctggtctttccatctcacattccctaacaggttttgtacgagtcacatactttaggcttaaatgtcatttattagtcatatcttttctctgcagcaataaaatatagatataaatattaaagtttgtctatgagtaacaaaattgataaaacccaaaaatataacaaattcttataaaaccaaaaattaaaatgttactgaagatgcctttcttagtgtatttagctttaaaggaaaccacctgattcgttctgtattcactgatggttgcacagtcctagtgtcaacactgagggcctgttt

SEQ ID NO: 10485 - DNA, 377 bp, Homo sapiens
gccgtcaggtgcgggcccaggtggcaggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcg

SEQ ID NO: 10486 - DNA, 649 bp, Homo sapiens
caaggaactgaaggacatctggcaatgtactgagtgaggaactgaggcccacagtccagcagtctccaaggaatcaaatcccacaacagccatgtgagtgagcatggaagtagatcttccccggtcaagcccccagaaggacccagccctgcggacaccttgaccgaaacctgtgagagctccggaaatagaggaaccagcattccctctggaatacatcagcactgttgcctttgaggctggcctgcttgaatgcacacctgagctccggattcacaggtaggtgtgtgacctttcttaacttctctgggcctcagcatactcctttttacagtgggaataacaatagcacctctcacacgaagttctggagggagtcgaaaaattggcacaggcaagcactccataaaatctgcagtgggctagaatccacactgcataccttggtcaccacagcccccctcctgccttactccaaccaggtcttctttgatccctgctttctttacacactctagcctcatccacaccttcttgtttccaaacatgacaagctcactcccacctctaggcctttgtccttgcagatcttctccctgggaggctctttccaaagactttgacaacatctacttgtcacatcattctg

SEQ ID NO: 10487 - DNA, 439 bp, Homo sapiens
tttaaatttagaccttttgagttaactcttctaatagtttgtgctccaagagagcccagcacacccttccatgaatggtgtcttttcaaagataactgtttttgaatgttcattgaaaaaattgtagagtagtcactcatcattttttcagttacactcaaataacaactattagtagacgtgttatttttataaagaatgaacagatgaggccaggaacagtggctcatgcctgtaatcccaacactttgggaggctgaggtgggcggatcatctgaggtcaggagtttgagaccagcatgaccaacatggaaaaactccgtctctactaaaaatacaaaattagttgggcgtggtggtgcatgcctgtaattccagctactcaggaggctgaggcaggagaatcgcttgaacctgggaggtggaggttgtggtgagc

SEQ ID NO: 10488 - DNA, 530 bp, Homo sapiens
aataaattatggtacatttccttcaatgactgtgcagtcctcagaagagattaggctgatctttaccaattgacgtgaaaagatgatgatattaagtgaaaaaaaaacaggttgctggctgggcatggtggcttatgcctataatcctaacactttgggaggccaaggtaggaggatcgcttgagcctaggagtttgaggctatcctgggtaacaaagtgagacccatctctacaaaaaaaatcaagaaattatctggatgtggtggcacatggtcccagctacactggaggctgaggcgggagaatcacttgagcccaggaggtggagtctccagtgattcatgtttgtgttattgcactccagcctgagcaacacagtgagaccctgtcttaaaaagaaaagaaagagaccgggcgtggtggctcacgcctgtaatcccagcactttgggaggccgaggcgggcagatcacctgaggtcaggagttcgagaccagcctggccaacatggtgaaaccccggctctacta

SEQ ID NO: 10489 - DNA, 347 bp, Homo sapiens
ctaccccagtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatgggtaaggacatctgtccatagtaatttagattctgcccttggaaggcctacttcctccaatgtgaaatgctcacctggctttcaaaaaccagtcgaattttgatatcctgtt

SEQ ID NO: 10490 - DNA, 381 bp, Homo sapiens
  misc_feature 326, 351, 375: n = A,T,C or G
cttgacagctcatgttggtgtagtcttgtttagattgaatcttttgaccttctggtacctgaagatttatgtttttcatcagatttgcaaagttttatgctattatctctttaaataatctttctatccctttgtctttctcttctcctctatgaatttctgcaactcaaacatttgctcttttcacagtctcataaatcctgtaagtgttccttattacttttcattcttttttctttttccttctctagctgtattttcagacaacctgtctgagttcaaattctttcctctacatgattaattctgatattgatgctctttgntgcattttttcattttattcattgnatttttcagctccagaatttctgnttcttt

SEQ ID NO: 10491 - DNA, 81 bp, Homo sapiens
aaatgtgatacagtttaacaaaacccattgttctgtaactatacatagattttcaaaatgtcataaaaagtgcagttatga

SEQ ID NO: 10492 - DNA, 465 bp, Homo sapiens
aaaaaaagcttaatagtcataatatatatgggatttttacaaaagaaaaacaccaaaatagaaacatgtataaaggaaattaaaaggaaatcaccaaagacaaaataagaaacccctcaaaaaacagcaaattaaaatgagacatttttgggttgggcgtggtggctcacgcctgaaatcccagcactttggcaggccgaagtggctagatcccttgaggccaggtgtttgggacgagcctggccaatatggcgaaacccctctttactaaaaatacaaatattagccagtggtggtggtgcacgccagtaatcccagctacctgggaggctgaggcatgagatcacttgaacccgggaggcagaggttgcagtgagccaagatcgcaccactgcactccagcctaggtgacagagcaagactctgtctaaaacaatttttttaaaataaaataaaatgggacat

SEQ ID NO: 10493 - DNA, 590 bp, Homo sapiens
tgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctcttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcaacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctc

SEQ ID NO: 10494 - DNA, 550 bp, Homo sapiens
tacaggctcatgcctgtaatcccagcactttgggaggctgaggtgggccgatcacttgaacccaggagtttgagaccagcctgggcaacatggcaaaaccccatctctacagaaaatacaaaagccagatgtggtggcgcatgcctgtggtcccagctacttgggagactgaggtgggaggattgcttgagcccaggaggtggaggttacagtgaaccaagattgcaccactgcgctccagccagggtgacagggtgagaccctgtctcaaataataataataataataataacaacaacaataataatacctattgttctgattgccaatctttattgtttataatctgtttcatgtttagagacttttagaggaggctgtagagtctcctactgtcttctgccttactgtttaaccaattcatggtgaggaaactattctaacctaatctttcttgctgctaatgaaccagctcttaatctgtttattttaatcaagaatagcatgggagctgggcatggtggcactcacatgtagtcccagctactc

SEQ ID NO: 10495 - DNA, 423 bp, Homo sapiens
  misc_feature 334: n = A,T,C or G
gagtctgtgaataaaacaataaaagccgtgggttttatgaacagtttcagtttggattttcaagaagcaaaagaaggtgtcaaaagaacgaccaaggaataagaggctttcagaaataaccaagaacatcaaaaataaagaggacttttacaagtgaaaaatgcagtaatcaaaaatgaactcaaaagagagattaaatagattagacacaactgaagagaaacttagtaagtgagaagctctatcagaagaaattatgcctaatacatggagacaaagaaatggaaaatattcaagaggagttaggaaacgtgtaggaaagaatgaacagctntaatgtatgttgaattgatatgcaagaaataggaaatgcaggcccggtgcaatggctcatgcctgtaattctagcactttgggaagctg

SEQ ID NO: 10496 - DNA, 449 bp, Homo sapiens
aaatcacctgggatgttttaagtctcagctcccaggcttcaccccaggttattatatgaaaatctggggttgaaactcaggcatcagtgtatttcaaagctcaccatgtgattccaaggtatgtgcatatttgagagcctttgccttaaaagaaggagcaggtgactcatactagcaagatagtgaacagatcaccaggccagccttgtgggtagaaataatcgtgacactctgacactgttctctactaagttaatcaacatgtttaccccatgtactacataaaaattacttaatcagcccgggcgcggtggctcatgcctgtaatccctgcactttgggaggccgaggcaggcggatcatggggtcaggagatcgaaaccatcctggctaacacggtgaaatcccgtctctactaaaaaaaaaaatacaaaaaattagctgggcct

SEQ ID NO: 10497 - DNA, 566 bp, Homo sapiens
cagggatgattccctcttacaacattttgttttgttcattttgcttttccaagaggtagaaactgaatttacatctaaattcttggtaagaaaaattcctgaataagatttgagggtgtcaggtcttagaacagagatgctcatctcaggcaaaatggatcctaagggggagcaagccacactagacattcaacaaaaagcagcatcatgaacattttcaacagctcattgttaatgttcctcataaaaaggacaggttcacttgcactgaggattcttttagggtaagagccattgaatagcccttcttggggccaggcgcggtggctcacacctgtaatcccagcactttgggaggctgaggcaggcagatcacttgaggccaggagttcgagaccagcctggccaacaaagtgaaaccccatccctactaaaaatacaaaaattagccaggaaccggtggtgaacgcctgtaatcccagctactcgggaggctgaggcaggagaatagcttgaacccaggaagcagaggttccagtgagctgagatcacaccactgcacgcca

SEQ ID NO: 10498 - DNA, 610 bp, Homo sapiens
tgggattagaggcgtgtgccaccatgcctggctaatttttgcatttttagtagagacaggatttcatcatgtttgctaggctggtctcaaactcctgccctcaggtgatccatctaccatggcctcccagagtgttgggattacaggtgtgagacaccgcacctggataacagtctgttgttgatcaccagtttttatataatttttcttttgaacacaagtatattataaaaatacttgaaaggagtattcaaaaattgattttgaataccgggttaaagattcaggtatggtcgttttcctacttcgaaatgcaaaggaggtaaactcacagaagaaaacgatgtccacagaacaccaagagattggggattgtggcatatctctgggtgaaaggaagcagatgggaggatgtttactgacgaaatagtatgagaagttgtagttaaaaacacaaattaggccgggcgcggtggctcacgcctgtaatcccagtactttgggaggccgagtcgggcggatcacgaggtcagcagatcgagaccatcctggctaacactgtgaaacccctccggctaactcagtgaaaccccgtctctactaaaaatac

SEQ ID NO: 10499 - DNA, 506 bp, Homo sapiens
tcttagagcacactgacttccttgtttccactagcaatttatttttttcttccacaatattctacatattagtccttgtatacttcttgacttttccaggtttgtctatttatgtaaactgcattgccttacaaattattattttaaatttattttaactttatatcttcatctaaaccataattcattgcattctaaaaaatatcagaactggtcactaatcattttcatgaaatagtgtccaactacatgccagatagtaattctaatccaaatatttctgcaacacagaaatttttattttcacttgacagattaaaaactgaggctaggccaggcacagtggctcatgcctgtaatcccagcattttgggaggtggaggtgggcggatcacctgaggttgggagtttgagaccaacctgaccaacatggagaaaccctgtctctactaaaaatacaaaaattagccaggcgtggtggcacatgcctgtaatcccagctactc

SEQ ID NO: 10500 - DNA, 411 bp, Homo sapiens
gctaccgtgtcaccacttacagctctgtcattatcactagttgtccttcccaatgtcccttaactaccttttcagtcgtatctcctgctactccccttctcattgtctaccctctccctgcccctcaacacacacctgtgttttaaccagatagaactacctggaagcttcttagaaggtaaaacctctagccctatcttcagacctatgaattgcactttatgagtatcccagggtattaaatatgcacattgaagtttaagaagcactggtctggctgggcgcagtggctcatgcctataatcccagcagtttgtgaggctgaggtgggtggattgcttgaggccaggagttcgagaccagcctggccaacatggcaaaacctcgtctctaccaatatataaataaata

SEQ ID NO: 10501 - DNA, 558 bp, Homo sapiens
aggtttcagtgagccgagatcacgccactgcactccatccagcctgggcgacagagcaagattccatctcaaaaaagtaaaaataaaaataataaaataaatagaatgcacacctaaaatgttgatgcataattccagctctctctcttgaccttccctagttgggaaaaactgtactgatttaacacccttaaaagcagaatggatgtgatggctcacaactgtaatcccagcagtttgggaggccaagatgggaggatcacttaagcccgggagttcaagaccagcctgggcaacgtagcaagacccagtctctacaaaaaaaaaattaaaaattagccaggtgtgctggcacacccctatagtcccagttacttgggaggctgaggcaggaggatcacttgagcccaggaggttgaggatgcagtgagccataatcacaccactgcactccagaccaggcgacagagtaatttaaaattttgatgcacagttctaacttattctttctattcccccaaggggagaaaactctactgatttaacacccttaaaagc

SEQ ID NO: 10502 - DNA, 623 bp, Homo sapiens
  misc_feature 558: n = A,T,C or G
tgtcaagttactattattccctttataatttgcagtttaagatgaaatgcactagttttagtgcttcatctgtaaaactacttttttatgtgaatttattttttaaaaaatgtctgtcactaaagagaaaatcatcatcgcttggcatggataaaaacactaactgccaaagtcattaacttttggccaaataccaaagccagctaaagtcacagggccttggcctgtattctttgttaaaaagagattaacaactgtcgggtgataaacataagatataccagcaccaaactgaactttctcctctaaataatcataaggattgaccaaaaactgaaaagcaaattgcttgctcactatatgtgattccttgttacttagggtcacctccgtataccctctaaaattgttacttacatgctttgcagttggacatattttggtttaaatcccagctccaccaacacctcagacttcatctcctaagcctcggtttccttctctgtaaaacagggataatagtagcacctgcctaagggcttgtgcaaattagattgngatagtgaatgatgtatagttggtgcttgcttaatgaatgacgtggtcagtgtcaatggcgtgtc

SEQ ID NO: 10503 - DNA, 504 bp, Homo sapiens
gccctgctaaaatgatgcttagcctgaaaaatcggagtattacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcactgttttgcacccaagaagtatttgctcagggaatgagggggttagattcctcctcattcattaccattcttactaggcagaggcctcattgggattaaaagacaggaatgtaactctctgcccactgatagggaatgtgtgtttgctctttgtatcccaggggtgtgatacctctttcctgtggtcactctgcacttaagatattttg

SEQ ID NO: 10504 - DNA, 572 bp, Homo sapiens
gggtttgaaaaacaaaccgaaaaagatgggctacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagagtttcgctcttgttgcccaggctggagtgcaatggcgcaatctcggctcactgcaaccgatacctcctgagttcaagcgattctcctgcctcagcctctcaagtagctgggattacctgcgtatgccaccacacccagctaatttttttttttgaatttagtagagatgggatttcaccatgtt

SEQ ID NO: 10505 - DNA, 588 bp, Homo sapiens
ggcacgagctttcttaaaaccatctaaaataaaaccttcttattttagtagtgtcagtgaaaataagcagtgacatttcttagaattctcagctttcaaatctacatgctgtgatcctgtctgcctaccatctggacagtttttgtttactcttgggttcccccatggagtaaaagtctcaaatcatctagcattgtttctcttatcctcaggtgatccacccgcctcagcctcccagagggctgagattacaagtgtgagccactgcgcccagcctacagaggactattgagcatccaatgactatgctaggtatgcaggtatagtactaagtaacaggagttcctaatcctaagaggttctccatctagcagaagaaaaccaaacacttatgtggtaaatgaagagggctatggatagccattgaaaaaaggctgtggatggaggtaagagagtttggcatgttcatggacttacaaataggttgggtgttcctgagccaggatatgtgaggggagagtggtacaagtgggtattagaaaggtagttaggggccaggtgcggtggctcatgcatgtaatcccagca

SEQ ID NO: 10506 - DNA, 569 bp, Homo sapiens
tcgattcgcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctataattcctatccacactataaatggaagaaaaaaattaatagcttc

SEQ ID NO: 10507 - DNA, 507 bp, Homo sapiens
ggcacgagacaataatgttctgaatccttcctgttcatgctgctttcttaattcatttctccatgtcatcaagaggttggataacttatttctaagctcaaggttaaaaatcatgtcacctttttttttttttcccccaccccaaccctaaaaaaattggcaatggagaaagaaccttaacccaaaaggggtggctaaaataaggcaccccaacccttgggtttttccaaaaaccccgttttaacttttctttttccctaacccctcccccaaacctaaccaaagggggaggggccttaattgcaaaaaaaaaccggggaaaaaaacctaatggctgaaaaccggaccttttatggccgggttaaacctaaccggggcccttttaagttggttttaacacctaactagggaaagaatttggcccttttttggcaaaaattcctggaaaaccctaccagtacctggtttggttcttaacggggggtataaaaccaaaccctaaaggtt

SEQ ID NO: 10508 - DNA, 388 bp, Homo sapiens
ggcacgaggatctttatgcatttcccactactcccttactgtcttttagcattcacagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttt

SEQ ID NO: 10509 - DNA, 545 bp, Homo sapiens
ctataaatagaactgtcgtgaagatgcaatgagatgaattttagctcagagcctgccacctggtgacttacccatgttaggtattgtggttacagctctgctgtcaaaccacttctccaactctctttctagcctcagttcatttgtcaaagggtttggccccagtattttgctggatattcagaagtacgacctcacgtctgcagaatgccactgactttcacacgaggcctcccaggaagggatgccaggcctcagacactagctgttggatctcgggacttgccactccactttggcatttttcaggaccacacggcatacagttgatctaacagtctttcctgtcctcccagtggtcagctgcagcccagttctagggcttctgtgggagaagacaggagagggctgggagtcagggcacacagatgtgtcagatgaggctttgcttgcaaggagctcaccacttgggtggtggagaaggcccagaaggcactactacagtgctcccaaatcaggaaaagattgctaaatgcccgtatact

SEQ ID NO: 10510 - DNA, 501 bp, Homo sapiens
gtgggctgcctgcctgctctgagctctctcttgcacgctctctcttctctcccaggctctggctcatgcacatgcaacaggtgcgtctgtctatatgtctgggttcttgacttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacat

SEQ ID NO: 10511 - DNA, 484 bp, Homo sapiens
gaggagccccagagtatctcaagggacttgcaggaactgcagaagaagctgtctctgctgatagactccttccagaataactcaaaggtcagtttccaatcactatgtataatggaaaatcccaatataacactagcataaacaagatagaaagttatttctttctccagtagaaggaatttggaggtaagtcaagaatctttctggcttaccgccctgccatgtctatgctgtgaccttcaaactccttgtctgagatgactgcaagagcatcagccattgtatccatctttcaggcaacaggatttgaggaggggggaagagagaagtgcaagccacctacaatttaaggaaacttctgggagtcgcacacaatacttccaattacatcccttaagccaacattgagtcatttgccactaatggcaaatgcaattctttagctggataaagaagtctgtgcaacagatatcatccttttttt

SEQ ID NO: 10512 - DNA, 414 bp, Homo sapiens
cgttgctgtcggggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttttttttttttttttttggggcccctccccttccgggcaagggggggggtccttttttaaacccagggaaaaaccggcccccccctttggtggacgaagggctctaagggcccccccgggccccagggcccacccgggccccatttggcccgggtggttgcccggccccggaaaaccccggggccccggttcctttacgggggatttaggggcggggggtccagggaccattccctttcccggggagttataccgcgaaag

SEQ ID NO: 10513 - DNA, 557 bp, Homo sapiens
gcttgacatatgtagtttccagaaattttgtcagtgtttcttagaacttgtttaaggtgccatgaaatatagcagtgaaatgtaaagtgttggaattgtttttctaggaaaactcattgtagatggagagcaaggtatctaataggatgtggaagttataaataaatacaagaagacatgaggcagcagagagaaagagaaagtagcagagagaaagtgaaagtagcagagagaaagtagccaagagaaagtgatggtccattcatttgtttatgtactcaacatcttccagttactgcctactatgtgccaggcaatatgcttgatgtttgggggatatgttggtgaatgacagagacacatccctgtcctaacggaggtttcaccctactgggacacacaggcaagaaattagtcccactgttcacgggatatttcttataatcagattgctcacatttcagtagatatacagagaatactagaagatgtttacatcttattattgctccttatatatcctctgttcttttaattctctagtaatcctatttcac

SEQ ID NO: 10514 - DNA, 234 bp, Homo sapiens
  misc_feature 234: n = A,T,C or G
acgacagaaggggttaatatcaaatcacccaccacataacaatgctttggtaaatgatggactgcatggacacaggtggttccttaagattaccatggagccaaaaaattcctagcacctagttgtgaatcacaacgcattactcatgtgtttgtggggacattgatgtaaataaatctactatgctgaccatcatagaaaaatattgcacataccattatggacgaggccttn

SEQ ID NO: 10515 - DNA, 543 bp, Homo sapiens
gtcccagaacttgtctcattgctgtcaaacatgacaccatagtccttctctggttcttcctggcaaagaccttctgaaaatcgttttgtgatgaaagttagcacaattcactgtgaaaggtcccctgggtaggtgggtcacaaccctgctcctcctcttgctctctgactacaagactttggtgaggggctccctgtcccagagtcttctttcttcgcttgttagcataatcacagtcctcactacaaagccagcctgtaaggggtaggtgagttagcaaacgtggaggcctctgcccagcacccagctcacagacggagctcaccctccagaagctagaatcatgtaatataaaaatacattattctggccaggcgcggtggctcatgcctgtaatcccagcactttgggaggccgaggcgggcggatcatgaggtcaggagatcaagaccatcctggctaccacggtgaaaccccgtctccactaaaaatacaaaaaattagctgggcatggtggcgggcacctgtagtcccagctactcg

SEQ ID NO: 10516 - DNA, 415 bp, Homo sapiens
cagttctgatagaatgcagaatttctccaatagaactaaacaacaaaagatggaaagcaatagtggaaaagtatgttaagctctacaaaccagagtacactatatttacaaaattttaaaatcctgaatgaatcaataaatttaggtaattttttttgtcagtgtcaaaatactagctgagaagagtttcatcataaatgttctgaactctacttttaaatatcattgattcccaaagaaatttaagctgataaaaagtaccagaatttcttaaaaagaaactcttcctgtccttttccttccttcattcagtcttttaaaggttatttgtccttctcttcactacgagaataaaggatgagaatttttacttttctactgcttgacttcaggaatattaaaaacattattaaaa

SEQ ID NO: 10517 - DNA, 373 bp, Homo sapiens
  misc_feature 78, 282: n = A,T,C or G
acggtccaatgaagagtggaaactttggtggtagcaggaacatggggggaccatatggtggaggaaactatggtccangaggcagtggaggaagtgggggttatggtgggaggagccgatactgagcttcttcctatttgccatgggcttcactgtataaataggagatgatgagagcccagaggtaacagaacagcttcaggttatcgaaataacaatgttaaggaaactcttatctcagtcatgcataaatatgcagtgatatggcagaagacaccagancagatgcagagagccattttgtgaatggattggattatttaataacattaccttactgtggaggaaggattgtaaaaaaaaaatgcctttg

SEQ ID NO: 10518 - DNA, 387 bp, Homo sapiens
cgttgctgtcggacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaa

SEQ ID NO: 10519 - DNA, 636 bp, Homo sapiens
tgggtttaccacctttctctaccccctactcacatcctggttatccaagagaacattatctcttttcttccaactgccttttcttcacctgtaatataaggaggctgaattctgatgtccatgccagcattcttatcctgtgagctgagcatcaggttttaagattttactcgttctctcatgcctgatacgggctgtgcacatgtagactattgactgacccagagaaaaaaccctgagggtcaggaagtgttacccaatgtggctcacttcgtaacaactcacaaggccaggccagcggagcccagaaagcaggcgctgatgccgagagtgatttgctcttctcactctactgctgctgcctggcctgtcggcctagagcggacagaactgtgtgctttgagccatccaggtccagttctctaaagacattgtgtggagatcagaggaagggagagactggtccctgcacttgtgggactagcctctcatacattaggatatctttcaaaaacacaaatataaaaggtactaaagcagctgcatgctggggagatagagcagatgaacaaacatgaatgggtaccatgcaggagagacgtcctttgcgtgggatgtggaagggacagaagctac

SEQ ID NO: 10520 - DNA, 578 bp, Homo sapiens
tctgagaactacatttacaagagaagatacgtgatatagttaaatgaaacagtgtgtgcaggctgaaagagttctagagcacatggtaagggtgggaaatgatgtgcaaacctcctgacagagataaagaaggcaattgtagcatttgtcctcaaaattcacttacaattcaaatgtttcaggggaatttccttatgttaatgtatctcttgtaatgtggctgaatgtacaaggaaatttggatttcctctacataaatttgataagaacattctatagctaacctgtgtttttgacaagttctataattaagctaattataataatagcttgatggtaatcactacaataatagctaacatttattgagtacttgctgtgtgtcagcactgtgttaaattactttaattgtgctctttcagggaaattaagagacttgcagaatgaaagagccacagcaggataaacaattgccagtctcccttgttggggactggctgactttataaagcaaacaaggcattctgtagtcactccaatgagtgggagattagaatgagaacggcattagaaagcac

SEQ ID NO: 10521 - DNA, 539 bp, Homo sapiens
ggcacgaggtagctaaggcagcttcaattaagactagggcattgttccaactaagggcagattttattctttaccttcctagctataaccttaggtatcctgaggatctaacaatgaaaatttttaaattatgaggaaaaacactaatgaatgtattcactattttgcattcaactatcctacatgaacatgaaaaaaagggaaatatatgtggcttatgtatataatggtatcattttaaatatcataaaactgggtttcttttcccttctctaaaaatagacctcaatagaaacctagtattaagtaacctagaatcaggaggtattccattactgctgattaagaagtgggaataggcaagtaaaatattaagtttcttttcaaactgcaaactatcttctaaaagatcctttctatatttgaagcataattttcactctgctctgtttaaacaatatttatcagtttaagttgtatttatttttagcagttcaattaaacaagaatcattactttggaaagcatattaattataa

SEQ ID NO: 10522 - DNA, 578 bp, Homo sapiens
gataacgtctggtttgattcacttattaaaagtagtccaaaggtccttcttggttgttggttgctccgcagttgctataattacaaggccattaatttggaaaccttttgtttctcatcttgctctgaggtcctcagctaacttacttaaccctgtagcttccttatccttttcctctctctctttcttgtttggtaatgttgtggggagactccatttacaaaaaggacagctaggattagctgaattgatgtaatgcttggaatgctgtaggaaaaacaaaaggtccaagtgggctttgaaattagtaacagattcatttttcttttgtctgcaggtctggtttagtgcaggtgggaaacactttaggaatggctttcaaaagcttatttatggccgggcatggtggctcacgcctgtaatcccagcactttgggaggctgaggtgggcggatcacgaggtcaggagatctagacaattctaggtaacatggtgaaaccccgtatctactaaaaatacaaaaaattagcttgggtgtggtggcaggcgcctgtagtcccagctactcgggaggctg

SEQ ID NO: 10523 - DNA, 79 bp, Homo sapiens
tgagtggacatgtgggttgtttctactttttggctagccagcttcctttttgtattccagacataccaggctacctttt

SEQ ID NO: 10524 - DNA, 561 bp, Homo sapiens
catgctctctacttcaactatagtaaaacgtccataaatgtttgtttagtaaatgaaagaaagagacacgctctgccccattttctctaagtgtcccaactctctgttccactaccatcttcaagtcttaggaatatgctattcattgtgccagaaatgtctcccagttgctcccaagactgtatttccctttctgtcttacaacgcagcaatagtcacctctttcatggcattttcttaaattacacctccttggtttggctttatagtcactcttaaaaacttgcacggtggctcatgcttgtaatcccagcactttgggaggtcgaggtgggcagatcacctgaggtcaggagttcgagaccagcctgaccaacatggagaaaccccatctctactaaaaatacaaaattagctgggcatggtggcgggcacctgtaatcccagccactcaggaggctgaggctggagaatcgctcgaacccgggaggaggaggttgtggtgagccaagatcgtgccattgcactccagcctgggcaacaagagtgaaactctgtccc

SEQ ID NO: 10525 - DNA, 618 bp, Homo sapiens
aggatggaaaaggaacttgagaaaactggaaggcatgggaagaccctgcttaccacacagggacaagtgtttaaaagaagtaacagttttaacagaggatgaagggaagtaaagaagggagagtgagagaacatggagctccaaccgcacatgctatttactgaataaatgtgctgttcagggtgattttagtccatcaacaaatattttgtgagccctactataggccaggcaaacagtaatgaaaaagcaggaagcatcctttccctcatggatcttacttctagtagttaaaacagacactgagcacaccattatatgtaattaattaatcgcaagtggataaatgctgtgaagaatatatacatagaagtgtaggaagataggctgggcgcagtggctcatgcctgtaatcccagcactttgggaggccgaggcgggcggatcacgaggtcaggagatggagaccatcctggctaacacggtgaaaccccatctctactaaaaatacagaaaaattagcttgggcatggtggagggcacctgtagtcccagctactcgggaggctgaggcaggagaatggtgtgaacccgggaggcagagcttgcagtgagctg

SEQ ID NO: 10526 - DNA, 584 bp, Homo sapiens
gttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacatta

SEQ ID NO: 10527 - DNA, 379 bp, Homo sapiens
ttcatctgtttgtttttacttttcaatatagtaactagaaaattttaaattgcgcatgtggttggcattatattcctactagatagcactactatagaatataagtctttaccctctttattatgcagccttcagatttttgaaagactgctatcgtttttccctcaaacatttttaaagggtagacttatcaggttcttttcaatgttatttatttaacataatttccttcaccattaaatgtgttctagcttttcagtctctacattgagctgaataccgtaagctgaagattagaattaagatgtaccatgccctgccaggtatcctggctaacacggtgaaacccccgtctctactaaaaatacaaaaaaaaatt

SEQ ID NO: 10528 - DNA, 378 bp, Homo sapiens
cgcctatccatggtcctagtattcttaaggataagcaaacagtcattttattcttcaaagaaaacagaacaattttaaacagactggttaatcaaaactagacaaagccccaactcctgcagttaggagtagatcaggacttctgtgggaaagagaccaggggaatctggcacagcttatagatattcaacaagcaaaaaatactgggatggaataaagtggcaggatggataaaagaaattgtattggggaaaaaaaactatgttttactttctttgttccctaactatgagctattcctacttcactatatatgtgaatgatggttctaaagagggaatcagatcattcatgtattcaacattcagcaaatatttg

SEQ ID NO: 10529 - DNA, 252 bp, Homo sapiens
tccgcctcccgggttcacgccattctcctgcctcagcctcccaagtagctgggactacaggcgcccgccactacgcccggctaattttttgtatttttagtagagacggggtttcaccgttttattcgggatggtctcgatctcctgacctcgtgatccgcccgcctcggcctcccaaagtgctgggattacaggcgtgagccaccgcgcccggccgatatcaaattttttaaatacaggaaaatgcaactc

SEQ ID NO: 10530 - DNA, 551 bp, Homo sapiens
agaactaacaattaaaggagaatgtgtattttctttcttcctttctttttttcaagaatcagggtctcactctgtcgcctaggatggagtgcagtagtatgatcatggttcactgcagcctcaacctcctgcctcaaacaatttttccatctcagcctcttgggtagcagggactacaggcgggtaccaccatgcccaactaatttgttagtgcgtttttttgtagagacagacagagtcttactatgtttccaggctagtcctgaattcctagcttcaaatgatctaaaggagaatgtttctacagcaggttagagacagtgtatctagtggggaaatccagctgttcacctcctcttttctgaaataaagtactactctattaattatgatatgaaatcatatatttgggtctactaaaaatttgttctctttattgaacttaatctccattttaggtttggtgaggctacttattaattttcaattgaacacttgtatttaaaagcatttctggctgggcatggtggctcacacctgtaatcccagca

SEQ ID NO: 10531 - DNA, 649 bp, Homo sapiens
caagatcctgtttctaaaagcaacaacaagaacaacaacaaatacctagaaagtgttagctaaaaatgttaacatggatggtgggctgaatggtattaaagtaaaattttgggcaatactgagcaaaaggcagggggccaagagtaaaagatgaactgggcagcccaaagagacatttaaggaagaaagggcctccatcctgggaagaggtgtcacagttgagcttcacggcccaagtcaatggctattacgtcctatatcatgagtgtactcaatcactagataaaaatgtcagaaaacccaagatggaacagctcaaaggacaaaatgcacctcaaaatattacaataagtatattatatatttttacatatttttactcaaaatatccagaactgtctagacattcatccttttctttcctagccttttaaataatatcaaagaaagactgtctcttctttcttttctcacttcttacctgtcttttgttcttcagatttacagggtgagaagaaagtgggagaagtaaaaacaattcagacaagaatcaaactggcctctaattagtcttaaggtaaaactggtaaaccaaataaagtatgtttagagatctgaaatccaacaccaaaacactataacacatgct

SEQ ID NO: 10532 - DNA, 427 bp, Homo sapiens
cagagttccaggatcctggattatgaggttcacaagagctgattgagctctctcatagcaacttacgtaaagggaaagctattgaatgactggtattgtttgagccctgggaactagtgcagacatctgtgtgctttcggatgtatggagttctttgtgtaatcagtccatttagcctagactgaaggaagatttttattcctctctctaaatttggcctctattatattagtctgagatttttttttccttataataatgactagcagtgtacagttcagactaagcaacgggaagatgtgtgtatgaaattgttagagaaatgaacaaccagagttacagtaaacagttgtcttatgttacagtgagtagaggtgattcctatgtggctgctcctaatgctggagcccctcagtctgattccaca

SEQ ID NO: 10533 - DNA, 569 bp, Homo sapiens
ccaaaggatgataccatgctttgtggctttccagatatccgccacccctaaccaataggacattggcaagtatctatgaaatcagattctcttcctgtcagtaagtgggggagttcaggaggccacttagatatatagtatgtcactgatcactggaacttcagcaagtcacagcctttctttaattgaatatgctttttcacaagtttctaagttaaataaaagaagtagaatgtcatatgaagctattcctaagaattttaggagactctagagaaaggtcagtttattctctagatcacattagattttcttttgaaggaagtatgccatttagctgatcattttaaatagtaatgaataattgtgtctggttaaataccaaggcccaagatctataaattaaattctttaaaaacaaaaataatctgattggtcagaagcagtggctcacgcctgtaatcccagcactttgggaggtcgaggcgggtggatcacctgaggtcaggagtttgagaccagcctggccaacatggtgaaaccccatctgtactaaaaatacaaaaatc

SEQ ID NO: 10534 - DNA, 435 bp, Homo sapiens
taatatttctgacttgagtgttattactctagcacactactcaagtgttttttaataaaaaaactactataccatttaaacttatcaactccatttgcatttgcattttttttgtcagtaaaatttttcaatttgctcacttcttttccttatggccaataaaagtggtgtgtggccagcctttaaaacagcaaaaacaatttataattcatgaaattacatatttctcagctgaattgaataccttatataatatcctatgaacttaaacaatggaaagtaaatcaatagcaatcccttctttctcacttttctgtgctttcccatgcactgcaccttctcttgtaaacattcagcctctgcatcatcacattaactctggttatctccaaaaatcattacattgtaatgattttattgtttcccatgtaaacc

SEQ ID NO: 10535 - DNA, 520 bp, Homo sapiens
gattataatcaagtgtaggcttcctgggttttgacatccttttagaacttgggtctggaattccagaaatgttaattgctgcttgtatttgttcttgtttgttttttagccagtatttgccctttctatccagccttatgaataatagcagtaaaatcacagtatcttggtcaggctgtattttttccttttttcttttttaagagacagtcatccaggccagagtgcagtttgatgatagcttgctgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagcctcggcctcccagagtgttgggattgcaggcgtgagccactgcacttggccaagttatttatttttaatctctcttgcccttctcccaaggcaggcttaag

SEQ ID NO: 10536 - DNA, 484 bp, Homo sapiens
gcacactttgtcatccagacataaccatcgttatcaaccggtgaacgtcagtcttacagaggttactcttaaaatttgcttcttctctcctctgctttcccaaattggcaaatattaccagaattgattcaattgcttgggccaaaacctgggactcatccacaatctttctctttatctcactccctgcatcagccacttatactgactctgcttggaaatacattggaatcttaccttgactactgtcattatggtccaggttatcatctatttcttgcttagattagccttctgaatattctctccacttccatttttgcctcatcagttgtattctctacacagtagccagagtgttttaaaaaacataatcccctttcccatcaaaattatttcagtgacttcccaccatatttagaattaaaaattcttggccaggtgcagtggctcacacctgtaatcccagtactttgggaagctg

SEQ ID NO: 10537 - DNA, 590 bp, Homo sapiens
ggaagaggatatggaaaagaattatcacatacccccactagacatcaaccatgtgtcttttttttctctttgagatggagtcttgctctgtcacctaggctggagtacagtggcacgatctcggctgactgcaacctccacctgtcaggttcaagtgattctcaattctcgtgcctcagcctcccaagtagctgggactacagacacccgccaccacacccatctaatttttctatttttagtagggacagggtttcgctgttttggccaggctggtctcgaactcctgatctcaagtgattcacctacctcggcctcccaaagtgatgggattacaggtgtgagccaccgtgcccggcccatctcctactaaatctataatcatctccctccactgttcccctttcttccctccaggtacaattgtaatgcatccctcccctgtccaaggccaattcctatgctcatgccttgcacacaatccctgcaccatctcagggacttcctccttttattatcacctctatctctaacctcatcaagcttcccctttctcctggattattcccatcagcatgcaaacattctga

SEQ ID NO: 10538 - DNA, 301 bp, Homo sapiens
atgactctgtatctaattattttataacatcaatatatccatgatatagtatcacataagacactgatacattggctattatatttgtaagccgaacttttaattttaaacagggcttgtactttgattatttatcaaagtatcaaattccacaaataaaatattcttttactttgaaatctctgtcttcactttatggctttttattatgaaactttatcttggtattactgatgtaccttgacttcattatactaaacaacactcatattagtacttcagtactggcaatacagctaag

SEQ ID NO: 10539 - DNA, 404 bp, Homo sapiens
aactgggggtgtctaatgtctgcaacataacaggactattgtaggaaattctgagactctataagcacttttaaatgtgaaaattaagaaggcatcccaaaaatgaatgggtccagtgctctgatttaagagtgtgtgacctgtcgtcattcatccagcagacccaagcaggcttagagaaagtaagacaggttagtattatattaagtttattttccctttattatgtatttccttaagaaattgcttaacttttctagcctcaaatcatctatcatgctcttcaagaattaaatgaaataatgcatcaatatagtacttcaaaaatcatagcacctgaaaatatagtggtcatgatcataaaaatgatctgggctgggcacggtggctcacacctgtaatcc

SEQ ID NO: 10540 - DNA, 523 bp, Homo sapiens
cccggccgccgccacgcagcacgagcgctccgagggacttttgaatggagacggagtcttgctctgtcgccaggctggagtgcaatggcccgatctcggctcattgcaacctccgcctcccgggttcaagtgattctcctgcctcagcctcccgagtagctgggacaacaggcataagccaccactctcggcaaattttgttgtatttttagtagagacagggtttcaccatattgtccaggctggtcttgaactcctgacctcatgatctgaccgccttggcctcccaaagtgctgggattacaggcgtgagccaccgcgcccggccaaggaatacttcttacaactgagtatcagaaagaaaatggccacccctgaagaactggtaggtttcttcttatcagataagaataactgcttcccttcctttacctcccttctttgactgcctcgaaaggtggagctccatttcatattctttacaactctagttgaagtgtggagtatattttcttcctccttc

SEQ ID NO: 10541 - DNA, 531 bp, Homo sapiens
atagctcatatttttgtgaccacctattgaccatctgttgactattttctatgacaacaaccaaattttttttttaagtcttaaatgtttaacttattttaaaatgcaacaaaatgaaacaaagaaacaaccctctaggaaagtgagcccaggagaagggagaagatgtgtattgtgctctaggcttagcttattcaaccatttagaacaatactaaagatttcaggccaggcacggtggctcacgcttgtgaccctggccctttgggaggccaaggtgggcggatcacttgaggtcaggagttcaagaccagcctggccaaaatggtgaaacccctgtctctactaaaattacgaaaataagcctggcgtggtggcacgtacctgtagtcccagctactcgggaggctgaggcaggagaattgcttgaacctgggagacggagggtgaagtgagctgagatctcaccattgcactccagcctggcaacagagcgagactctgtccaaaaaaaaaaaaaaaaaaaaaaaaa

SEQ ID NO: 10542 - DNA, 477 bp, Homo sapiens
gagcctggggactttccacacccccgtctcccgggttcaagcgattctcgtgcctcagcctcccaagtagctgggattacaggcatgcgccaccaccccggctaattttgtatttttagtagagacggggcttttccatgttggtcaggctggtcttgaactcccgacctcaggtaatccaccagcctcagccttctaaagtgctgggattacaggcgtgagccactgcacctggccgagtagttgatgactttttaaactgtggttgaggttccatgcacttctgacgcctctcccatgttggttcagcagctttgcgccccctgcctaactgcagacgtggcgggagatgagtccccgaacgcttggctgctcggtcaggcactgccacagcggccagcgtgctgcaggggttgctcagggagctcctccgtgttgtgaggccttattgctcacggcttacgtccagctcttctc

SEQ ID NO: 10543 - DNA, 524 bp, Homo sapiens
tataaaaagtctcacagaagaatgtaccccttcagcaagaagtaaaatgaacctaactgaatacaactcaggactctcaaccaagtgggaggtcagagactcaggagagagtcacctcagtcacctgtaaccatggaggagccgtgggggctcaagtggcctgtgctggtaccggggtgctgggtccccgcagtgttccagacgtccctgagcagtccactctgagtcctatctgggtcactgtgattttcatctaaggaaaaaattaaacttttagagaatggggcctggtgcggtggctcacgcctgtcatcccagcactctgggaggccgaggcgggcggatcacgaggtcaggagatcgagaccatcctggctaacacagtgaaaccccgtctctactaaaaatacaaaaaattagccgggagaggtggcaggcacctgtactcccagctattcgggaggctgaggcaggagaattgtgtgaacgcgggaggcggaccttgcagtgagccgagatcgcgc

SEQ ID NO: 10544 - DNA, 488 bp, Homo sapiens
ggaaactgggaagttcagtggagctgaggtacagactccactccaggaggaacaagggcacagaaagaagactgcagagcagggctgagcttgattgcaaaggttatactgcatgctgggaagtttacaattaatctgtagacaataagaaaccactggaggtgtggaagccaataaatcactcaatccgagaaaactggagcagagcaaggatggattactagtagggaggaacagatggcaagcaggccggttaggtgtctaatctgggcaagctgacaataaagcctggtagtgggaaatcaagaggacccagcatagggtaacaatctggagataaaattaatagactcaagaaacgcattagatgggaagtcaaggaagatgctgagatttctggtcaaggtttccacccggtcaataaagtgggttcttaaaccattaatgaagacagagatttaggaacagggagaagcagcaggaagagc

SEQ ID NO: 10545 - DNA, 433 bp, Homo sapiens
ctactcgggaggctgaggagaatcacttgaacccgggaggcggaggttgcagtgagctgagattgtgccactgcactctaacctgggtaacagagcaagactccgtctcaaaaaaacaaacaaacaaaaacaaaaataaatatacttgcaattcatggtggtttagaacgtttgcatcttatacttcattcttgtgatttatttagttgttttaaaaacaaactttgtgcttggtttctaaatgaagagataagagagaagatatcacctcctcaaacaacccatttcagctatgaatagctgctatttccaaaagatgaaaagctaaaatgactacattttctcttaaaatgttcatttttgaagttctagattttttttttggtcgggtgcggtggctcattcctgtaatcccagcactttgggaggctga

SEQ ID NO: 10546 - DNA, 364 bp, Homo sapiens
gaataaagatagttttattgcttcttttcccatctgtatgccttttatttcttcttcctgacttattgcactggctagcacgttcagtacaatgttgaataaaagtgatgagaacatacctacagggaagaggtcagaaagaaaaaaacaaacacaaagaagtggggagagcaaatgtttttgctttgttcctgatcttgtggacaaagtaatcattctttcactattaagaatgatttgccaggcgcggtggctcacacctgtaatcccagcactttggcaggcagaggtgggtggatcacgaggtcaggagttcaagaccagcctagccaagatggtgagaccctgtctctactaaaaatac

SEQ ID NO: 10547 - DNA, 480 bp, Homo sapiens
aggcgtgagccacagtgcctggccctagagtagtttctgtgttctttactgataaaagcaaatggctgtatttgaagctatactacccttccacataaaatggacccaaaaaataaagagttgtaaaacaggaagaaaagatcacagtattagagaacaagttcaggaagcccaatattcaaataggagttctagaaacagaacttggaggaaaactgagagaaggaattcagcaaaaaaaaaaattcaaggccgggcatggtggctcatgcctgtaatcccagcactttgggaggccgaggtgggcagatcataaggtcaggagatcgagaccatcctggctaacacggcgaaacccagtctctactaaaaatacaaaaaattacccgggcgtggtggcggggcctgtagtcccagctactcgggaggctgaggcaggagaatggcgtgaacccgggaggtggagcttgcagtgagccg

SEQ ID NO: 10548 - DNA, 85 bp, Homo sapiens
tctgtgcccactgttcgatttgttgggaatggggtgttaacatatgcaacaggggccgggcgcggtggcttcacgcctgtatccc

SEQ ID NO: 10549 - DNA, 605 bp, Homo sapiens
gcctcagaagcagcgctttgcggggaggagagggctgggtttcgaacccacaaggccttcaggacctgtgagggccccagcaggtagaggagcggaccatgaaccaggtaggagagagggaagaggggactgaaaaggtcgtcaggccatcagagaagttaatgaattcacctcaccctttcaagccaggagttctaaccaagagatcaagggcagaggcccctgggggcaggaaggtggggaccggaaagcagtgaggagatgacacagtgtcctctggaatctgggtaacaagctctgaagggccagagctaaaagggcatccctcctcctctgagactcttagggagtggccatggggtccaacagggtcttggactctggctcaggctggaggtttgaatgagcagggtaagaaaaagagagcctggctgcgcgcattggctcacgcctgtgatcccagcactctgggaggctggggtgggtggatcagctgaggtcaggagttcaagaccagcctgaccaacatggtgaaacccggtctctattaaatacaaaaaaaaattagccgggcatggtagcgcatgcctgtgatgccagctacc

SEQ ID NO: 10550 - DNA, 373 bp, Homo sapiens
cttaaattggtaaatggcatcagcgtatcaatgattacctccactcccatccccaaatccagtcagtcaggtatatattacctaccaaatataactcattatccttctagttttctgtgtccttgctgttactaaagaccaagttgggctgggcacggtggctcacacctataatccagctttgggaggctgaggtgggtggatcatgaggtcaggagatgaaggccagcctggctaacacagtgaaaccccatccctactaaaaatacaaaaaattagctgggcgtggtggcatgcacctgtagtcgcagctacttgggaggctgacgcaggagaatcacttgaacctgggaggtggaggttgcagtgagcc

SEQ ID NO: 10551 - DNA, 310 bp, Homo sapiens
agaactggggctgggttgcagcagggttggaaaagagagatagcggaaaaggtagccaggagcccaaacaggaagccaagccgagcagttaagactttatctccaagatagctgagcaatcaggacaggattttaaagacgagagtgacttgctaagactggcatttgaaagagctctggcttctggataatgcaggagaggggcaacactgaagaccagtttggggccatcacagttttccagggaaaagatgctggtgacttgaactgaaagtagtggaggagggtaaagagaaaacaaggaggttgt

SEQ ID NO: 10552 - DNA, 448 bp, Homo sapiens
aatttaaaataattgaaaagaactctgttgaaaccttgaagtagacttaacatgcttttcaaaagtatgtgtactctgactaagtgaaaaaacagttctggacaatgttttttcactctccaattaaaggtttatatttttaaaagcattaaagtacactttagaaagcaattatatttacctatcaattttagaaaatcaagtatttaaccaaataatttttggtttgtatccaaatgtgatcattctaaagtttgtacatactgtaaaatgaaagaactttgggaggtcgaggcaggtggatcacgaggtcaggagatcgagaccatcctggctaacatggtgaaaccctgtctctactaaaaatacaaaaaattatctgggcatggtgacatgcacctgtagtcccagctactcgggaggctgaggcaggaaaatggcgtgaacc

SEQ ID NO: 10553 - DNA, 563 bp, Homo sapiens
cagctactcgggaggctgagacaggggcctaggattaaataaggagttttggcaaaactaggctggaactccaaaacctgctacgtaagtactcacgagggttgctagttattagtattattactttgttgttatttttaggagtggagcaggttgtatttgtatcttacatcaccggctctggtcagatttcaattaatgtcacagataggatttaaacatttcttttattatttttaagattttaggccaggcacggtggctcccagcactttgggaggctgaggggggtggatcaccagaggtcaggggttcgagaccagcctggccaacatagtgaaactccgtctctactaaaaatacaaaaaaaattagctgggcatggtggcacgtgcctgtaaccccagctattcgggaggctgaggccaggagtttgagactagcctgggcaaatagtgagaacttgtctctaccaaaacaaaacaaaacaaccaacaacattaggccaggcgtggtggctcacacctgtaatcccagtactttggggggccgaggcaggcagt

SEQ ID NO: 10554 - DNA, 370 bp, Homo sapiens
ctcccaagtagctgggattacaggcacctgccaccatgcctgcctaattttttttgtatttttagtagagacagggtttcaccatgttggtcaggctggtctcgaactcctgacctcaagtgatctgcccacctcggcctcccaaagtgctgggattaaatgtgtgagccaccatgcctgttctcagtagattcttatattgtcttttcttctttaacctcttagaaagccaaaaggtaaaatttcagggtttagagagggtatggaaagtctagcttctcatgcccatctggatagagccagctgtttgtcctcattcaagaagatacttgccgggcacggtggctcacgcctgtaatcccagcacttt

SEQ ID NO: 10555 - DNA, 588 bp, Homo sapiens
atttacccttgtatttcccacagtacttcccatagtgagttacccttagtaaatactcagtaagtttaattgaatttaaattacctgtaagtcttaaaatgtgggattaaattaagaatatattgtcctggaaatacccaaatgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatactatatgattccacttatatgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacatttctggtctcaaggattttggataaaggatactcaatgtgcaacatgt

SEQ ID NO: 10556 - DNA, 530 bp, Homo sapiens
gatggaaggatgggtgaatgaatgagggaagtcaagcgatccccaagcgacttaggaatgtagttgctcccctgagaaaccaggcagctgccattctccgaagtgccccggcttgccaggcacagaaggtctcatggcacctcagagactggccctgcaagggacatggctgatggccaaatacagtcaccacctcgggctgcccaagctctgtcgagctggaatatggcagggctaacattacagaaaacaagttgacggcgtcagaaatgggagtttcatcaccctcagacgtgtttagccccaactgtgtgtcagtctctgctggactccagagcataaaggaagcaatcattgtccaaggaacagagtccctaaaggaggtagtggggtcaggggaaaaggaaggaaggaaagggacatttattaagaaatttattgtatgctgcagtttactctattatctcatttaatcttctgaacaatcctacaagactgaaggtgtaagagccatttctccacctggcagg

SEQ ID NO: 10557 - DNA, 535 bp, Homo sapiens
tctccatgagaaggtaagctccaggagtgcagggatttgatctttttgttcagttttgtcttaccagcacataaaacagtgcctggcctcatgatggtgacctccttatcttcagtcatctccttgatctcagcttagtccctcacaaactcccatgattttttttaaaggacatggatcttttactttttaaccttaaaaaaaatttactgccaatatctgtctagaccccttcctagtcttaaggaatctgctatctgagtgagctttggggtgacacaaaccctttctgctacaacggaagccaaattgagggatatccttactttctttgcccttaggtaaaatgagcaaggaaaggcacatgacctgggctcagacaataggtttcacctgcttgggcatatgactcttacagggggcaactaaaagacaaaggatgagattcatggttgtgttctaggccctagcagtatacagtggcagtgtcagcatcctgactgcgttgtttctgctactcagccttttctgcttt

SEQ ID NO: 10558 - DNA, 387 bp, Homo sapiens
gtatcctctctttttcatctccaccaacctctgtttactcctcttctctactacgtctaccagatatattaagttaataaaggcattcatatacttcagcaatgtttttggagtgggatgtgtgtgtgtgtgtgtgtgagagagagagagagagagagagaataagaacatgcatgctgaagtgctgaagcacctgcatcaacattactatcactacagtcatagtccaggaaagatgtctctgctctcaagcaagaaacaagaactaccatgatggtttgggaatgaggaaaaataagagggtgaaataagagagtgtatttgacattaagttgggaaattgcagaggaagcaacctaacattaggtgttaaaagacctggattct

SEQ ID NO: 10559 - DNA, 612 bp, Homo sapiens
tgatagcaaatataaatgtttatgagtaggggcatgggtggtgtagggttgattgatacacaaaggcctttgtgaggactcgtcttcatggaagtttaattattgcaagtacttttttaagaaagcatgacaggaacaataaaccttaaactcaacaatgattgctacctagaaaaatatgcttgaaatattgtctttttactatattagaaaagttgattcaatacaaaataagctcctaatgtagaagtgatcattaaaaaggtaaaaaagtgaggttggccgggcgtgttggctcacgcctgtaatcccagcactttgggaggccgaggcgggcggatcacgaggtcaggagatcgagaccatcctggctaacacggtgaaacccagtctctattaaacacacacacacacacacacacacacacacacacacacacaaagttagccgcgcgtggtggcgcgcgcctgtagtcccatctactcgggaggctgacgcaagagaatggcgtgaacccaggaggtggagcttgcagtgagctgagatcatgcccctgcaatacagcctgggcgacgagccagactccgtcccaaaaaaaaaaaaaaaaaaaa

SEQ ID NO: 10560 - DNA, 486 bp, Homo sapiens
cagagaagtggaaattacttcagattgtcatgaaaaagacaaatggagaaggtgggatgcatgaaaaatagacttttaaaattcctaaatcaatgccctcaagtcatctaaaatgattagaaacagtctatagttgtcttttatgaggagacaagaattatatgtgttccttgttttttttctccttctgcttgctgaagagttctggtttcacttgtcttgtccttttccttccctttgtcctgccttgagagactggttatattaagcttttgtgaggaatttcaggtgagagggaatggaggaagaaaaaagagacttagggacacatattcatacccatgtgtgtatgtgtatttatgtgatatatgtataattttatatatgtgataaatacatacacattacaaatgcaattatactatacttaatctttcatatgttttaaatccttcaagtttattatgaacatctccccatgtcaac

SEQ ID NO: 10561 - DNA, 552 bp, Homo sapiens
atcacaagcgtgtgccgtcattcccagctaatttttgtatttttagtagagatggggtttcaccatgttggctaggctggtctcgaactcctgacctcaagtgatccacccgccttggcctcctaaagtgctgggattacaggcggggggcaccatgcccaggccctggcttattatttttaaaaagtaggacttgagtttcccaccatgtgatcttcccacttccaaatttattattggagagagagataaagcagaatgcatagaagttcctttgcaagctaacctggcagtacggcatgggggaggaggaaagggatgaagggagaagtgccacaagtggtttttaggtaacttagcagtttgatttccaagctgtttcagggctgctagttttgtgtgtgcggctgctggatggactgttttgcatatcactgatttatatctctacagaacaaatcttgtgtttcttttggagatccacgagcaactggcatttgaaaaaatcaggcattattgactttaaaacacagtaatgttttctatatctct

SEQ ID NO: 10562 - DNA, 513 bp, Homo sapiens
gacagaagggatcctactcaggtgaaaaataagaattccagatacctcaagcatctggattgtgatagaatacctagacaaagcatcccttcttaggccgacctcatcctcgcttctcctcaacccctgaaaataaaaaacacatctgatagaaaaataatttccttgattatgaacatggataaagaaaaacttaaaactaaaaggatttgataaaaataattataaaagttcaacagaataagaatatttcaaacacaggcatgcatgccttacacacacgtatttctaaaaattatagggttttaggctgggcatggtggctcatgcctgtaatcccagcactttggaaggccgaggtgggtggatcacttgaggccagagaccagcctggccaacatgacgaaaccccatctctactaaaaatataaaaaagttagctgggtgtagtgtcacctgcctgtaatcccagctacttgggaggctgaggcgtgagaatcacttgaacctgtg

SEQ ID NO: 10563 - DNA, 662 bp, Homo sapiens
gagccaactcttagggcacattaatcttgaacttctggcctccaggattattaagaaaaattttctgttgtttaagccactcaggctgtggcattctgttctggaagcctgagctgactaaagcagaatcatgcactcactaaagaaacttctgaaaaatgcacataaggaagaagaactgaaatcaggaataaaatgatgagtaaagttacagtgatgcatatcagggaagatcaaaataagtaatgactgcacaaaacaatattaaatataaggattggattgagagaatatatgcaactgtaatagaattattgagcaacaataatatgcacatttgaaaacggtgataaagaatacaaaagatctattatttggaaagaagtagagatatgactcttttgtctttaacttaagaaagcacataaggccccgcgtggtggctaacgcctgtaatcccagcactttgggaggccgaggcgggtggatcatgaggtcaggagatagagaccatcctggctaacacggtgaaaccccatctctactaaaaaaataaaaaaaaaattagccgggcatggtggcgggcgcctgtagtcccacctactcgggaggctgaggctgaggcaggagaatgacatgaacccgggaggctgagcttgcag

SEQ ID NO: 10564 - DNA, 532 bp, Homo sapiens
ctctaggtcaagatttatcttctctaaggtaaaactcacaagggactgtcacattgttgggtgtgtataaatgaattttaaaaatcgtaataggccaggagatggcaccttttcctttaacataagctaaaaggatattttgtgagaactggaaattaaattagggccagccatggtaatgagctgtcaataagccagtcaactataacagagttaaataatatagtatttaagaactggagctggagtcttcattttctctatctttgcacctttacctaaacaaatacatacaccagtaatcttaataatcactttcagggaactgatgatttaaagttattgaatcaaggccaggcgcggtggctcacgcctgtaatcccagcactttgggaggtcgaggcaggtggatcggatcacctgaggtcaggagtttgagaccagccaggccaatgtgatgaaaccttgtctctactaaaaatacaaaaattagccaggcattggtggtgcacacctgaagtcccagctactc

SEQ ID NO: 10565 - DNA, 313 bp, Homo sapiens
atttttagtttactaacaggaagtaatttctttcccttaaaattcccttattttaaaagaaagattgtgtataacatatgaatcctgtcatttttgtcttgttggtcaggaatcgaaaataaaatttaacaggttttaacaagtgtgattgagatttgtttcctaatcactctacatgttttttctcttttgcatatatgtcattatttataagcaacttcaaatagaacagaaggtagggcataaattatcaacaactttagtccaaaaagatgttaatgaaaaaagtaacaatatttgtggtataatatat

SEQ ID NO: 10566 - DNA, 186 bp, Homo sapiens
gaagtatatgaggaaaactaatggaagataagggctatattaataaggtttgtttgtgcagacaaacaatcagtgtcaattctccatttccattgataagaatgttttctttctggttatgggagagcacctttctcatgggaaatgtatgtcaggccaggtgtggtggctcacacctgtaatccc

SEQ ID NO: 10567 - DNA, 480 bp, Homo sapiens
actgcttgagcccaggaggtcaaggctgcagtaagccttattcaagccactgcactccagcctgagtgacagagtgagaccctgtctcaagtaataataataatttatcctcaaagaccctacagtctagcaagggagagaagactattcacaaatattccttttgcaagtttaaaagtgctcaaaatcacaaggaagacataactaaaatgctatgatggctcaggaaaggaagaacttgcctctataagaatatgtaatcatactaattatgttttcataaatttagtgaggcatcatagcatagttataagaaggttaggcatggtggctcgtgcctgtaatcccagcactttgggaggctgagatgggaggatcacttgagcccaggagttggagacaagctggggcaacatagtgagattcccatctctacaaaaaacaaacaaaaaaagtagctaggtgtggtggcatgcacct

SEQ ID NO: 10568 - DNA, 608 bp, Homo sapiens
ctgggtgcagtggcaggcgcctgtagttccagctactccggaggctgaggcaggagaatgatgtgaacccggagggcagagcttgcagtgagccgagatcatgccactgcactccagcctgggcgacagagcaagactccatctcaaaacaaaaaacaaaacaaaacaaaaaacaaaaacaaacaaacaaaaaacaacaaacaaaaaacccttctatacatgccattatttacattggtgcatactttttcccaaaaacaaaatccttacagtagaattttgggtcaaatatgtgaaagtaatttagagctttgctatacctttcaaactgaactgacttatactcctacttgtgcactaatgcttttgtaacactatgcttttataaaaagtaataggagggccaggcatggtggctcacacctgtaatcccagcactttgggaggccaaggtgggcagatcatttgaggccaggagttcaaaactaacctagtcaacatgatgataccccgtctctacaaaaatacaaaaatcagccaggcatgggtggtgcacacctgtaatcccagtcactagggaggctgaggtgggagaatctcttgaaccc

SEQ ID NO: 10569 - DNA, 413 bp, Homo sapiens
acctgagtctgcaggttgagtgagaagagagttgttgacagctgagtaggctaagagtgtggctacagtcccaggcatctcagctgcaggtatagggagtatagaagtgacactgggagaccaggtggcctggatctgactggaggaggtgctgaatgccaagctaaagagcctgagtgttattctacaggcaatgacagcccaagaaacaggatatcacaaaggttaagaacaaggattctgggtttgaatcttggctccatctcttaagagctgtgtggcctttggcaaggtacccaagctctctatgcttatattttctcacctgtaaaatcagttgtagtgagaattacatgagtgttgatatgcaaagtgcttagaacagtgcctggcacatagtgacatacataagt

SEQ ID NO: 10570 - DNA, 571 bp, Homo sapiens
ttatcaaacgtatacttaattctttgaatgtgttagtatgtgttcaaagtacaccttaattttatatatacatatatttaaattacataaaataaataagccactaaaaatttttaaagattttcttatatttcctttcagtatttttatgtgcatgcatctgtacttggtaatattgttgaattcatgtttgcattgacaaagcctctccccttgcccaaactctagtcaggatcctctaagcctcctctcagccccagccttcagtgttcatcctagtctggcccacatctctcaggtttagtaagaaacttgcaaagaatcccctactctcagtactgatcacctttgatatctgatcaaatttgttatctcccaccaccctccagatgatttctgatcagtctggcctgccttcagtaagaatcctgttcgatctgtttaacccaaatcccctttgcccctgatgtttcctcttagtatccccagttgagccaattttcaaccattaaaaaaatcttggacaaaattaagttcagataggttccagagtgcttatgttcagttcttg

SEQ ID NO: 10571 - DNA, 300 bp, Homo sapiens
ctaatgtctgttcatagcataccgttccatcaccctgtttcacagcactggctgaagtataggacaatggactcaggttgtctccctcaggggcattcaaactgacatttaaaggcaaaacaaaccttcgagggaaagatttggctgctgaattatggacctgtttgggaagaagaaagagatgaaaattgtcattcatatggtaacagtatgtcccaataatttagatccagtcaacatcattggcattcctaaatatttaaataaatgataatttccattcattcatctacttaatat

SEQ ID NO: 10572 - DNA, 627 bp, Homo sapiens
tgcgcctgtagtcccagctacttgggagactgaggtgggaggatcccatgaactcaggaggtcaaagctgcagtgagctatgattaaaacctgagctccagtctgggtgacagagcgagacctgtctggaaaaaaacaaaacaaaacagaaaagaaagtgttgagtgaaaacgtcttcaggtgcctttcaccttgagagagggcacgaggctgagggcgccttcccgtcctccgaagcctccatccctcccctggcattttgcctttcacactgtaatttctttcttgagaatcagccgaccgaaattaagtctcccaaattcctgagtaagccgaaaagctatttttcttgcaaatcttagatgaacataatttaatataaggcataaactaatgcaataaagaccatatattacagcagtggcacaattaaaaagcaaaagccgacggaagagactgacagacagcgtgttaaccacagggaaaataaaatagaaataagaggtaggttatattctgtgcataaataactttaaagaggaacaataaatgacttctataacttttaatatatgtgttggagattatttaattgcagtgaagtaagaagtgataaattgagctgaa

SEQ ID NO: 10573 - DNA, 54 bp, Homo sapiens
ggcacgaggagagagagagagagagagagagagagagagagagagagagagaga

SEQ ID NO: 10574 - DNA, 211 bp, Homo sapiens
aactagcacatcacagccccagagtgggctccaaaccggtagaccagaaagcctgcaggataatttcccccttaagatgggtagatttactgttccacagccaacaggtggatacgcgtaactagaacaatctgtcatgggactaagtggaagaatccatcagcactacacagcatcttttcttcaaatacaactgtaaaatctccactga

SEQ ID NO: 10575 - DNA, 322 bp, Homo sapiens
gagagggaggtgggtgctggtgtcttctgagcctcactttgccctttggcaggctcctgggaagcagccacagaaatgaagcctgttccccaggagccccagggatggggacagaccccgtcctccctttgaggagctcccaggttagaggagaaggcagctctgtggacagacaaggattcggtcgggggcaccagggctgtgatcaggaggtgccggagaatcggggattggaagcagagagattcttggcagttgaagcaaaagtcggatctttggtttcagatgttaaaagcaacatgcattgcttgtttctggttct

SEQ ID NO: 10576 - DNA, 621 bp, Homo sapiens
ggcacgaggaggagtagagttcattggagtcttaaactctctgatatcacttaaagctggagtttattttaaaacaaatgaagcatgggccacctcatgatgcagtggctcctctctggttgaggagagggaaaattggaaaaactggtcgagtaattatcaataattttttttaaaaagaggatcccaaactgtaaaagattgaaataatctttctcaggattttttaaatgtctaagattatgatgtcatatctcccacttaccttataagtaaaaaggttaatatcaagtaacttattagctcttaaagtaaaattgaacttattaaaagctatctatgatttaatagatttaataaaattccttcacgacctggtacccttgtgaaactgtaaaatatatcatatggggggagttttttaactcttattttttgaaaatttactgtagcttctatttcgtgaataagaatgttttgattttgatcatacaaataacttttgtagatttttgtttacttttgggggggttcccttagaagacattaaaaaaaaatactgccttggtctgtgcaggctgctgtaatgaaatactatgaacttggcagcttataaacaac

SEQ ID NO: 10577 - DNA, 384 bp, Homo sapiens
ggcccgggcgagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagcgagagagcgcgccccccccctctttgtttttttgggaggggggagggaaagaacacacactcacgcgcccgtttttttttttttccgcactgcacgaaggagagacccgcgtgtcttttttttatactctctatatatgtacacgcagagagagagacacacacatttatttctcgcactctccctcccct

SEQ ID NO: 10578 - DNA, 524 bp, Homo sapiens
ggcacgagcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctac

SEQ ID NO: 10579 - DNA, 436 bp, Homo sapiens
ggcacgaggagagaactagtctcgagactagttctctcctagtctcgagagcagttttttttttttttttttaaccaaaaaactggccgggttttttaattaacctttcccttaaataaaaaaaggggcttaaaaaataaacttgtttaaaaaccccttttttttacaactatggcccctttttacttttacattcagcttttcgaaaaaagctttcagcattattatttttggaactattaaagatttttccttcttccctggcccggggggttaacccgggggggctttaaacccatttccctttttttttttcccttttttcccaacccaaagctggggaaaaccccggggaaaaaaaccgaattggtttcccagaaaaaaggggcaaaaaagggttttttttttaaaaaaaaacctggcctttggggggcct

SEQ ID NO: 10580 - DNA, 640 bp, Homo sapiens
ggcacgaggcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttacgtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaagcagaagtggccagtgtttgggttgaaaggatccaggaacatccagctatttatgatagcatttgcttcattatgtcaagttcaacaaatgttgacttgctggtgaaggtggggga

SEQ ID NO: 10581 - DNA, 575 bp, Homo sapiens
gaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggac

SEQ ID NO: 10582 - DNA, 557 bp, Homo sapiens
ggcacgagggctggtttgtctggggagacagacaggatgttgtggagctggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatggttctcatttggctaagcatcaaaatcacctagggagtcggtgcaaaacaaaatatcccagtcccctcccctgaaacactgactcaggaggtttggttgggggccaggagtctgttcctaaatattccaggtagttctggtgcaggtaagtggccctgagacagtatgttgggaaatgctgacgtaaaggtatcagggccgggcgctgtggctcatgac

SEQ ID NO: 10583 - DNA, 508 bp, Homo sapiens
gatagaggcaggtggatcccttgagcttaggaatttgagactaggctgggcaacatagtgagacctcatctctaaaattaaaaaaataaaagccaccagaaaaaaacctaaaaacatgccaagtgacatcagtctttgatgaaaatggcagcagaagagtgatgccatgggtgggggtgggaaatgctatttcagcagagagggagctgtcacggaagacaccatgtggctgggcgcggtggctcacacctgtaatcccaacacgttgggaggccaaggtgggcagatcacttgaggtcaggagttcaagaccagcctggccaacatggcaaaaccccatctctactaaaatccaaaaattagtcgggtatggcagtgcacgcctgtggtcccagatactcagaaggctgaggcaggagaatcatttgaacctgggaagtggaggttgcagtgagccaagatcgtgtcactgcactctagcctaggtgatacagcgagactcagtctc

SEQ ID NO: 10584 - DNA, 375 bp, Homo sapiens
cgttgctgtcgagagaagcagcaccgcatggtgtggcaggagaaggaggacatgcacaagcaattggttgaagcttcagagacattgaaatcccaagccaaagaactgaaagatgcccatcagcagcaaaagctggccctgcaggagttcttggagctcaatgagctcatggcagagctctactcccagaagcagaaggtgtgggacaaggaggaggagatggaagtagccatgcagaaagctgacatgatgtggcaggagatctgaagatccaagaagctcagaaagaggatgctgtttagccagatgcggtggctcacgcctgtaatcccagcactttgggaggtcgaggcgggtggatggcctgaggtcagg

SEQ ID NO: 10585 - DNA, 499 bp, Homo sapiens
aggaaacaagttctgctagtgatgctttcatttgatcaggggagagttagaagccagccacccaattagtgacttgcacaaaacccagtgaattaagtacacttgacaaataccaaatgacacatttttgtgccagaccagagcaaggagaaggctgttctgacccaacagaaagggctccccagggcagtgttttcctaacttccctgtgaatgggaattgcctgggacattgttaaaacacagcttcccagacccctctcttggggctcttgatttagtgcttctgggatgggcccaggaatttgtatttttagcaagcatctcaggtgattcttacaagaaattctgggaatgcttgctctaaaaaaagcccttcctgctgggtgtggtggctcacgtctgtaatcccagcactttgggaggctgaggcaggtggatcacctaaggtcgggagttggagaccagcctgaccaacatggagaaactccgtctctact

SEQ ID NO: 10586 - DNA, 568 bp, Homo sapiens
ggcaccagatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgactt

SEQ ID NO: 10587 - DNA, 306 bp, Homo sapiens
acagacagcactgagatatacagaaagtaagaactttcaggctgggcgcggtggctcacgcctgtaatcccagcactttgggaggctgaggcgggtggatcacgaggtcaggagatcgagaccatcctggctaacacagtgaaaccccgtctctactaaaaatacaaaaattagccaggtgtggtggcgggcacctgtagtcccagctactcaggaggctgaggcaggagaatggcgtgaacctggaaggcggagcttgcagtgagccaagatcgcgccactgcactccagcctgggcgacagagc

SEQ ID NO: 10588 - DNA, 221 bp, Homo sapiens
ccgctgccgtcgcgcgccttggtttttctgtaccttttttttttttttttttaaaactcccggcaaaaacacccccccccttaaccccaaaaaaactaaattacaaacggggcccctttgccccaaaatgggcctaaaccctaaaaatggaaaaattttttttttaaaaaccccccccccgggaaaaaacgggtggcccttttttttgtaaaaggggttta

SEQ ID NO: 10589 - DNA, 362 bp, Homo sapiens
  misc_feature 101, 102, 103, 104, 106, 115, 118: n = A,T,C or G
ggattcgagtgattctcctgccttagcctccagagtagctgggattacaggtgtgtgccaccacgcctggataattttgtatttttagtaaagatgggggnnnntncatgatggnccngggggggtgaaactcctgtcctcacgtgttctgtgcgcctggcccttcctaagtgctgggagaactcccctttaagtttgctacctagtttggacttccagtgccccctgggggggggggataatttgtgcctttttagaacagacggattttttccttttttttcacgaaagtgtggttctcctaaccttgagcgattcgcccgggtcggtttcctctttttcttggcctccccgccctcgcg

SEQ ID NO: 10590 - DNA, 110 bp, Homo sapiens
gtgaagttgagctcctttttctttttaatctccatggaacaatttgtataatttcttgatttaaattgctaaactgagctcttcattcaaaatactaaacaataatttct

SEQ ID NO: 10591 - DNA, 392 bp, Homo sapiens
ggcacgagagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccaaggctcccccaaaacatccaggagtgctgaaagtggaagccatcctggagaaggtgcaggggctggagcaggctgtagacaactttgaaggcaagaagactgacaaaaagtacctgatgatcga

SEQ ID NO: 10592 - DNA, 534 bp, Homo sapiens
cggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatga

SEQ ID NO: 10593 - DNA, 354 bp, Homo sapiens
ttgcttatactctcactggaaccaatgcatggaacaggtggtgcagacctccagctgataatgcattgaagaacaggcatcatatgctaaatgagtgaagctagagatctattcgacaccataaggacctgcatgaaacaaaatagcatcaccacttgcatacgtaacatgatcaacccacaggcctatatgttggaagtgctgtccggggctgttactgtctcttctggttataaagcagacatgtggccatcttttccgcagggttagagtgggctcctttctttttggaatccttttcttctcctttggtagcagctccctgcctccagggcttccgccaccagcgtctct

SEQ ID NO: 10594 - DNA, 568 bp, Homo sapiens
attctttaagattctcactttcataaatagtgttgtagtgaaattaattgattcatgaggaatattttccacatgtttttctgcattgtgggaacatgttcatatagcacattattaagactgctggccaggcgcggtggctcacgcctgtaatcccagcaccctggaaggccaaagcaagtggatcactttaggtcaggaattcaagaccagcctggccaacatggtgaaaccccacctctactaaaaatacaaaaattagccgggggtggtgactcatgtacctgtaattccagctacttgggaggctgagacatgataatcacttgtacccagggagcggaggttgcagtgagctgagatcctgtcactgtactctagcctgggcaacagagtgagactctatctccaaaaaaataaaaacaatttttgtgacaattgctttggatccaagtttatgtttgctctttttttgtttttgttttgttttttgttttgagacaggttcttactttgtcgccctggctgcagtgcagtgatgccatcatggttcactgtagcctctacc

SEQ ID NO: 10595 - DNA, 95 bp, Homo sapiens
gacccagaattatctgggtcaataaaaataattggcctattcttctataattgttggtgctaaaatgaccaaataaattagttcacttcagtaac

SEQ ID NO: 10596 - DNA, 203 bp, Homo sapiens
  misc_feature 203: n = A,T,C or G
gcttcacgacttatggcatgtcttatttaaaaaaaaaaaaggactaggggcaaataacattttgagggggtatttaattaaaaatccatgcagggacagctgagttcgggttttatgttgggctaatacttcctaaaattatttagaacaggactggctagaaaaactttctgcgatgatgcaagggttctatgtctatgctn

SEQ ID NO: 10597 - DNA, 354 bp, Homo sapiens
aaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagtttataacaagacaatcaagaaacatattctactatttatatgctctcaccaccctccctctcctcattttgataattggattggatctatattatcaa

SEQ ID NO: 10598 - DNA, 156 bp, Homo sapiens
cgtccgctgtcgaaaatgaaaagacaagccatagactgggagaaataatttgcaaaacatacatcttacagagcacttgtgtccagaatgtataaagaactctttttatttgcgtgtgtgtgtgtgtgtgtgtgtgtgtgtgtgtgtgtgtgtgtg

SEQ ID NO: 10599 - DNA, 453 bp, Homo sapiens
aattatgtaacatttctgtacacagtacatcagtggacttaattagggtgcctcctacctcttacacaaatgaaatgctttgtgacaggtattcttcctcttgaaaggcttttttaagaaaaaaaataatttttaactgtatactagataatctgagattgcaaaaggagcaccagataagggaggtgttaccatgctgtgcagcagaagaaggcttataattaagtttactacactttaatgttggggttattctgagctcaagatactcatagacctttgtctgatttccagggtcttatatctcacttcaccctttgtgtttagttactgaaagtttagggatgaagatagatttacagtttatttttacaagaaacttcatactgtatgctttgcttccagtctcttgaagattatttgaattcatctgtgggtttatgcccatacaca

SEQ ID NO: 10600 - DNA, 502 bp, Homo sapiens
cagtgttctaacaagtactttaatggatagggtttgctgtctaaaacatgaagaggtaactcaacattcctttcagtgccacaggttaagaacttggagaactggctttcctgaggagcttctagctccagaggttgtacatgctcatggcagcaacaacccattgaccacttcttcaaagtagttcactgccaaggagaatcaaaattcaatttggattcccaatactcagcctaccttcaatttcccatcaagcctatattcttagcctttagtttaagtgtgggttatcttaacagctcacttggcctcagttcaaagtgaaatttcctgagtccttgaaagaagtagaaacccaatcaatgagtttttctcttggtctctactttgtgagaaggatacatttctagaaatttcaataccttccaagtgtcagaaggaaatataatgtagctgttgaaatttgcgatgtaggataataaggtactcccttagtgccagg

SEQ ID NO: 10601 - DNA, 480 bp, Homo sapiens
gagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgacctcccacctcctgctggccctgcccatagcccacttccgccaacattgcctccacacctctcctcccttcattccactaaagagtggccatccgttgggcgcccactgcctcctctggttctcctttcttcccagtaacagcccgctgctgtcccagggtggccaagccccgttaatgtgcatccactcctttccatctctgtctctctgcctctcttcctctctccctagtcaccctcatcgattcctacgagtcttctaacttcatgttcct

SEQ ID NO: 10602 - DNA, 750 bp, Homo sapiens
tcaatatttttttaggaatatctgcacatgtacatttacattcaagttgataacactggtggtttcatttcaatacaaattatgctagagaactgacatttcagacatggtcatatatatgctatttgaattcctttatcttgatacagatcttgattgtgaatctcttgatgatagatgtgcagctaatttgtcccgaaactcatgaagataattgtattgcttgatggtctgtattgccccggatcctcttaggtctcgcaggctgtctatggcttgctctggtgatattgtgtcagacaggtatagtaggagacaagcagctacaagacaagatctcccaagtcctccatagcagtgtattaaggtttttcggtaatttttaaggcaggttgtaagctcttccattatttcacagcagctggctatgtcaggagtccctccatctgcgattggatgatgatgggtgataattccacattgctggtagagatcacagaggtttgggactctatattatgacagttcctctctggtgcagaaaacaaatatgtcttgtataccacagctctctagttcttctgtatcattttggacattacttctaacatcgttaaatgtacaacctgcaagagcacataaaccgagatactgagtacaattcactcgtgacacagatagccatgatatatgaaatggagtctgttcatcttcaataggctcgttatctgatgagtcagactcacttgt

SEQ ID NO: 10603 - DNA, 577 bp, Homo sapiens
cggcacgaggcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaatatgcccagatttgctattggattaaaggaaactacctggattgtagggaggggtgacacagtgttccctcctggcagcaat

SEQ ID NO: 10604 - DNA, 331 bp, Homo sapiens
actggggaaaaagtcccatctttttcaatttgattcaaaaaaaaaaaaccaaatttcaaaaccaccaaatttttttggtccccaaagcatttcaaacctgaaaaacagcccatttttccaaaataagtttacttcaagaggatttcatttcaacaaaattataaatagtttactgactttctcattaacaggattggatctgtatattatgctacctttttcctaggaacatttttaccctccttttttacctacaatttagccaacctttttagaacatgctaactgagtcaatcctaagggcaatccagttccttaattttaaaaacct

SEQ ID NO: 10605 - DNA, 357 bp, Homo sapiens
tctgagtcccgctggcatccagctccctgctcctggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccct

SEQ ID NO: 10606 - DNA, 442 bp, Homo sapiens
aagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgt

SEQ ID NO: 10607 - DNA, 581 bp, Homo sapiens
  misc_feature 485, 501, 523, 536, 575: n = A,T,C or G
gggacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcangaggctgaggtgggangatcgctagagccaaagaccangctacagtgagcntgatcatgctactgcctccagcctgggtgacatgagacntggctc

SEQ ID NO: 10608 - DNA, 421 bp, Homo sapiens
  misc_feature 1, 17, 19, 25, 27, 52, 57, 85, 124, 131, 138, 143, 169, 175,176, 182, 195, 200, 208, 218, 219, 222, 223, 230, 245, 249,264, 282, 299, 302, 315, 320, 322, 323, 324, 329, 331, 339,355, 372, 376, 381, 398, 414, 417: n = A,T,C or G
nctacggttagcaagangncgacanantggtacggctgcatattagacgacncacanacccggcatgcttgaagacgactttatnggtaccgcatgcaagatgactatataatgttacctttgntagaaancgacatngtggntcggctgtacctttacttctcacctntgcggnngtattnctacgacagaggntactnctgcaatnttacctcagnntgnnacgggtncgactgactccattntttnatgcatgcacctttntatcgaactgctggcctnagcatcctcctcctggnctntcaagtgctaggntacangnnnagccncncactttgngaatttgtgctgcttnttgcagtctgggatttnaganattcncaagtcttccttgaganttgcttatgatcccanaanaaat

SEQ ID NO: 10609 - DNA, 741 bp, Homo sapiens
  misc_feature 685, 715: n = A,T,C or G
gggggctttccgtgcggtgcggcgagtgaggctccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagataaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaagctggagaagtagtgaacaagaagcacggtgaggcggaaagaaaaccaaaactcaaatagtgtgcagcattcctggagctttgaaacacagttngctgtttggttgcctggaggggtatattgntgtatcgctgccttctctggttggtg

SEQ ID NO: 10610 - DNA, 890 bp, Homo sapiens
  misc_feature 1, 9, 643, 701, 703, 746, 759, 781, 783, 794, 798, 805, 815,843, 864, 866, 872, 876, 877, 878, 879, 881, 889: n = A,T,C or G
nacgacagnaagggggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagactatttcatggtccaacctgttgccatagttgttangctttcctttagtgtgaatattagatgaaatttctctttaagttcttatagggtaggngnggaaagcttattataatctgagggttgggttattgtcaaaccnataactgatgaanaggctgggcaatttctgctganantggtagtgganaacntagaggnttttgccaangcccaaagctagaaaagctgctttaatngtttggctttttaagcttttntnccgacnaccnnnnantgttttgna

SEQ ID NO: 10611 - DNA, 170 bp, Homo sapiens
ataatttaatcatcttcaataaatagtgctgtataaacatgtttatttgtaattttttttcttttttttttgaaatggagtcttgctttgttgcccaggctggattgcagtggcacaatcttggctcactgcaacctctgcctcccaggttcaagtgattctcctgcctc

SEQ ID NO: 10612 - DNA, 764 bp, Homo sapiens
  misc_feature 628, 670, 707, 718, 729, 736, 741, 756, 763: n = A,T,C or G
tattctttaatcttacaaaactcactgcatttcaccttttctctaaaaccttcctagtctatcattttcatcccctacctccgagtgaagcatttcttcccttttccctcccagcatgttatattccttctgcataactcctgatggcacagaggtgttcacctggcattctgcccccctagcccgagctccttgagaacagggtggttatcagtcatctcttttcacagcactgacagtgcctggcacacagtgagcgccccactaatgcatcctcagtgaaggagggagtacctctggtttctccacccctctttctattttagccacttcatttttgcttaaaccaggtacttgtctaaaaatggtcttggaatctgtgctttgttatttaaatcctctgatgcttagcttttatttgggccactgctagctacattgtaatctttttacggtcaggaaccatgtggtattgctggctctatccctcatgatacattgcatgtaatatgcactcaagaagtgcctattggccgggcatggtggctcacacccgtaatcccagcactttgggaggcaaggcgggcaggtcacgaggcaggagttcgagacagcctgacaacatggngaactccgtctctactaaaatacaaagtagctggcatggggngatgtctgtaccccgtctcagagctgagcagaaatcnttgaccgaagngaggtcaggancagatgncatgnctcacctgggacagnagatcgnt

SEQ ID NO: 10613 - DNA, 643 bp, Homo sapiens
agcttcggttattgtcatccattgtggaagagctgctggatcggtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctcatggccctcggccgcttgcacccgctctctgttgtacactttcaatcaacactttttcagactaaaggccaaacctaatcgtgg

SEQ ID NO: 10614 - DNA, 392 bp, Homo sapiens
tggtacgcctgcaggtaccggtccggaattcccgggtcgactactactactaaattcgcggccgcgtcgaccttttactaaatattcggtataagaaagtgaaggttattggccaggcatagtggctcacggctatattcccagcacttcgggaggctgaggcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctc

SEQ ID NO: 10615 - DNA, 482 bp, Homo sapiens
ttggtgttttccatgtgtacctttatttaatgctcacagcatccctatgagataggacttcttatacctacttcacagagaagaaaatggagacatggaaggttaaggagcttgtgtgacatcatacacttagcaaatgaaagagcacagatttgattccacgactctctgcttgcaaagtctaagatgatgttaatatagcaggaaactcacataatgtctataaacccattgcctgtggggtgttaaatctccaagaatcagcctttggtccccgacctgtagaggatgtggatcttctagctgagcctgatgctcttgtgggttcctcactgggtcctgacctctgagtattcggtggaggtgtccttggaaggattcatcccatgaaagttgagggaagcataatgcagctcctcatccatctccacagtaggggcggcacctgaacagcttgaggtttcagtggggccatgtaactt

SEQ ID NO: 10616 - DNA, 722 bp, Homo sapiens
  misc_feature 573, 644, 656, 678: n = A,T,C or G
gtacaaaaatatatttatttggtgtaatagttacaaaatattcatttccacaataatattttagcaatgcattggaatgttaaaaaaaattctttgtattaatgattcttgcaaagaccctcaaaacatcccaggggtagaactgtggttcaagaggaaaagcaatttccccaagtctctgtatctaaaaaacactagtaccatgaaagataaacttaaaacatcaataacttaaataagaattaacattacttaaggcataatgtttcacatcaacaaacaaaattcattataataaaataaaacagggtgtctggggaaagctaggggaaaataagttagctgcagattcttgggttgtggagtgagtgttcaagtcttcggagtttgggtttgcttgtccaggtggtccatggaatcctgaacccacttctgcttggggtcagcacagatcttcttggccacaatggtcttgaagatcacagcttctttgggacacttgctgctggtgatcttctatagctcgcgagcctctgcactgagatcttcctattggtgaaagtatagcagcangtgactggggcattgattgcatcttgctgagcgagcactttgggaatgaaagtggctgctatgagcagcangcacagaagggncgcagagactttcatgctggangcgagagtgcgagcttcagtttgagaatttgatgtttctgggtt

SEQ ID NO: 10617 - DNA, 416 bp, Homo sapiens
tatgacgtcgcatgcacgcgtacgtaagcttggatcctctagagcggccgcctactactactaaattcgcggccgcgtcgacggtgactttgcacactgaaaccaataatttatttaaatttttaaaaattgggaccgtgcgtggtggttcacgcctatattcccagcactttgggaggccgaggcaggtggatcacaaggtcaagaatttgaggccaacctggccaacatggtggaacccctgtctctactaaaaatacaaaaattagttgggtgcagtggcaggtacctgtaatcccagctactcgagaggctgaggcaggagaatcacttgaagccagaaggcggaggttgcggtgaactgagttcacgccactgcactccagcctgggtgacagaacaagactccatctcag

SEQ ID NO: 10618 - DNA, 499 bp, Homo sapiens
actcaaatggtttttattttggtatctgacatttctaacaaaacgccaggtagacggagttaaaaagaatccaccgcacgaaaggtaaacaaagcagaccctcagaaactccctggcaaggatgttcccctccccagattggcccagtttcaccagcaactggtctcagctcagccttatgcctttccactgacaccccccacccctccacattctcgtgattcagaccaggaacttctcggctgattgtgtccgtgtgtctgagggaggggcacgctggaacctgggaacctactgggcacctctaatgcagatgagaaaaacttgagaatgtgaaagtagatcagtccccgctcccacccgaaggtgcagagacgcgggacattaaccagcagcacgcgggggtgaagtaactcaggccactctcctccccactgcccagggcgggtgcacgccccaggacctcctcccaggccccacacccacgcaaggcgacagg

SEQ ID NO: 10619 - DNA, 546 bp, Homo sapiens
gcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggg

SEQ ID NO: 10620 - DNA, 518 bp, Homo sapiens
tcggcacgaggctgtgcgcagcttccacctgaagaactttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccac

SEQ ID NO: 10621 - DNA, 614 bp, Homo sapiens
caaatgaaaagtactatattactagggaaactgcattataataattcacaaaagttattccaaaggggaaaaaaataaattatctcatataaaataatacatggtatgtgtgaataatcttggctactgtcttcagagagcctgtttgctgccagccacctgcacccctgtggggggagcagatgttgtctggaggtgactctcctccagcgcgatggagctgggtccctcctccaggagctggattggggtgattaaatgagtctggagttttggaggaactggatgaggacttggtagacaaacttgtactgagcgatagtctggatcatgaacatcctctgctccctgaggagcctcagcatcatgggcacttccaccttttcgttatgttccaagcagtagatcatcagctcagaaagaatgagcacgccggtccttcccaccccagcactacagtggaccacgatgggcgggtgccggttcttggtgccttccagcatgctgttggtatggcgacggaccgactggatctcctccaagtaggataaaaatccttggacatcctctggacagccgtgatctggccagtcagtatattgtaaatgccacac

SEQ ID NO: 10622 - DNA, 568 bp, Homo sapiens
tcggcacgagggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaacattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgca

SEQ ID NO: 10623 - DNA, 484 bp, Homo sapiens
tatttagtgacactatagaaggtacgcctgcaggtaccggtccggaattcccgggtcgacccacgcgtccggcagagcctggagcatctccactatggcctgggctccactacttctcaccctcctcgctcactgcacaggttcttgggccaattttatgctgactcagccgcactctgtgtcggagtctccggggaagtcggtcatcatctcctgcacccgcaccagtggcagcattgccagtaactatgtgcaatggtaccagcagcgcccgggcagtgcccccaccactgtcatttatgccgataacaaaagaccctccggggtccctgataggttctcgggctccatcgacagctcctccaactctgcctccctcaccatctctgggctgaagactgaggacgaggctgactactactgtcagtcttatcagaccaacaataatgctgtgttcggaggcggcacccacctgaccgtcctc

SEQ ID NO: 10624 - DNA, 423 bp, Homo sapiens
tttgtacaaaaaagcggctggtaccggtccggaattcccgggatatcgtcgacccacgcgtccgatcgtatatattctcaaagaattcacacataggcaatctcatttaatactcaaaatgttctcatttaagactcaaggctaggcacagtggctcatgcccataatgctaagacttttaaaggccaaggctggaggattacttgagctcaggagtttgagaccagcctgggcaacagagtaagacctcgtctctacacaaaattttaaaagttagccgggtgtggtggtgtgcatctgtagttccagctactccggaggctgaggcaggagtatttcttgaacctgggaggcagaggttgcagtgagccgagatcacaccactacactccagcctgggcaacaagagtgaaactctgtctc

SEQ ID NO: 10625 - DNA, 319 bp, Homo sapiens
tatgacgtcgcatgcacgcgtacgtaagcttggatcctctagagcggccgcctactactactaaattcgcggccgcgtcgacgaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgt

SEQ ID NO: 10626 - DNA, 360 bp, Homo sapiens
  misc_feature 18, 109, 321, 338, 348, 357: n = A,T,C or G
agaagagggcagagcgtngcatggggctgctccccaggacctgagcaggaacctggagttttcagagctgcctgatcattgctacagaatgaactctagcccagctggnaccccaagtccacagccctccagggcaaatgggaacatcaacctggggccttcagcaacccaaatgcccagcccacggacttcgacttcctcaaagtcatcggcaaagggaactacgggaaggtcctactggccaagcgcaagtctgatggggcgttctatgcagtgaaggtactacagaaaaagtccatctttaaagaagaaagagcagancacattcatggcagacngcagttgtgntttctggangaa

SEQ ID NO: 10627 - DNA, 662 bp, Homo sapiens
actcagctaagaggtatttattcagttgctggcacctctcccagtgtaaatctggacttggctccagagaaggtgtttcattacagcgggggcttagtttgcttcctgtagttagtagcgtttcatggttttctttatccagtgtacaaagcttgagactttggtgcaggctcgtggaggcatgccattgtttcgtccataggagacaatgcccctgggccaccttgttacacacaagagggcctccagagtcccccttaaaggaagtctttttaatctctgggtcccccacgcacaactcaatggtactgtcgtaataatggcgtaagtcagattcgcactttcgatcttcctgcactgtcatcttcacctcttgtagtgtgtgtgagtgttttcccaggggggccgtctgcccccagccggccacactgcatgtctgccctggcttcacctgagccttgttgctaggtagcctgaggggctgcacagctctggtccgcttggcctctctctccagctgcagtagcatgatgtcgttggagaagttcttaggattataggctggatggcggatgggtcctttcacagggataaactgctgcgacggctcctgtcctttgatattgtgtgccccccagggtgacaatttatggagcttaccc

SEQ ID NO: 10628 - DNA, 510 bp, Homo sapiens
tcggcacgaggccccttcttcccctcccactgggacctaccagaatgccccagagaatccttaggtgttggctgccagtctcccagcccccttactctgcccccttgaagaagaggtcagttctgtggaccagccccgggggcattcttcctatgccagactctggagggacaagactgcacctagctttattctcaggaccgtccttcccgcagtctaacttcagtttctcctgcttcaactagagtcctctttttattcctctcacagggatatagtgaatggtcagtgcatttgcaggtggggtgatgatctattttggacactggtacaggagagggtcttgcaatataagaaacaagagctgttatgaaccaccaccttctgggtgcattgggcttatagactcagtaatttattttcttcctgatctgacatcctacatggggcagccctccccacattattaccttattcgaagtatgaaccaacatgttcaccccaccccca

SEQ ID NO: 10629 - DNA, 471 bp, Homo sapiens
  misc_feature 302: n = A,T,C or G
gcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctntgcacagaggaacctctgtaatgacgaccgtggtggcggtgggggcagtggcactgttgggggtgggtggtctggcatcacaggcttctttacaccacgcttaatcaaaaagacactgggcttacgagcaggtaaacccacagccagtgatgacacttccaagcctttt

SEQ ID NO: 10630 - DNA, 684 bp, Homo sapiens
gggggtacacaattttttaccacaacacaaagcaaaaacagatcttgccatttgttgtcatctctgctgagtgctaatagtgggggttcaaagttttccatttgtttaaatgctgctttgaagtttccatgaagaattacagtttggtgacactttttatccaaggtacaaaggctgagactttggtataaacaccaggagaatccttgactccacagccatacccccaggaggtcaccccatacaccacccagctctctccgggccgttcacacatgagtggtcctccgctgtctccctggcagctgtccacgcgtttgtgttcatggaggtttccagcacaaagcattctccctgtaaaccgacccttataacgttcttcacaaaaccttttaggaagtaagggaatggctgcttgttgtagtgttcttgaataggctcgtcctgtgtcaccccatcctgttatgtaacagttggatgctgttttctgtggcctctctctccagagtggtaaacaggctggcaaaacattggctgctgaatctggcacattgctcttctggtccttgtaatctaaccaaggctatgtcataatcactgccggtcggttcgatactcccgatgaatcaccatctgttgaacttcaatttcttcctcaaactcctctggtacccaaatatggta

SEQ ID NO: 10631 - DNA, 459 bp, Homo sapiens
  misc_feature 197, 293, 298, 346, 355, 362, 433: n = A,T,C or G
ctgtacttggtagtatatttaattgttgtgacaatgacaatataaagaaaagaatgaatatccaataagtaatttttcagttctgctcagtctttacacatgaacacagtctctatattgcagtctgaaaatgtgcttctgctataggctggaaagtgttatatcaggagcagcataaacaaaattactaatttganctaaatttcaagggaatcttttgtttcctgccttgttcatttctaaataatagacaatacagagaacactattaaaaactagctaaattacattangcctngctactttccttaaaatgaatgaaaatgctgggccagcatcctatatncattcttancagcacncccaaatttccttcttcaatgcttggcctttttccccgaagtgggttccaatgggaagaccgggagttgcngaaatgtgggacgcctttctgggaag

SEQ ID NO: 10632 - DNA, 142 bp, Homo sapiens
ctctcgatatgagctagtgctgaacattggtgtcggtgcctatggcacagtgtacaagtcccgtgatcgccacagtggccacttagctgctctaagagctgtgagagtccccagtgtatcagcaggtggaggaggcattgca

SEQ ID NO: 10633 - DNA, 486 bp, Homo sapiens
  misc_feature 467: n = A,T,C or G
gctggaggcctcccaggcacctttcctggaataccatcagcctctcctgcgggaaggggcatccagcagccgggccaaaagtggttcatctcaccttatgttcaaacccaagctaaactgggctgagctgggaggtggggaaagctttgggattatgggaactgagaggggcaagcaaagcgtggctctggggttagcgagaagtcaaaccccaaacctttgcacagggtccttggggtcggtgatgggggtagaaggtgtgtgtgtggatcacctactgtggggcatggtgcgcgcaaagacgaaggtggcggcgctgcagcccacggtgtgcgccgcgtggttgcaggcatggatgtcgatccggtattccgtgaagtggcgcaggccgctcagcaccgctcgctcacggggcaccttgtcctcctggatctcgaaatccgagctgttgccccccagccggaggngcccagctgcccggctgtg

SEQ ID NO: 10634 - DNA, 168 bp, Homo sapiens
gggtaccgggccccccctcgaggtcgacggtatcgataagcttgatatcgaattcctgcagcccgggggatccactagttctagagcggccgccaccgcggtggagctccagcttttgttccctttagtgagggttaatttcgagcttggcgtaatcatggtcatagc

SEQ ID NO: 10635 - DNA, 394 bp, Homo sapiens
  misc_feature 206, 286, 374, 376: n = A,T,C or G
agccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccggnctggccaatggagctgctgtgccacgaggtggacccggtccgcagggccgtgcgggaccgaacctgctccgagacgaccncgtcctgcagaacctgctcaccatcgaggagcgctaccttccgcagtgctccttactttcaagtgccgtgcagaaggacattccaaancnctacattgcgcagaatgg

SEQ ID NO: 10636 - DNA, 301 bp, Homo sapiens
  misc_feature 130, 173, 184, 207, 209, 218, 224, 240, 243, 252, 265, 270,279, 280, 281, 282, 285, 288, 290: n = A,T,C or G
gggggactccgccttccacgtgcacccactgcctcttcccttctcgcttgggaactctagtctcgcctcgggttgcaatggaccccaactgctcctgtgccgctgcaggtgtctcctgcacctgcgccanctcctgcaagtgcaaagagtgcaaatgcacctcctgcaagaanagctgctgctnctgctgccctgtgggctgtgccnantgtgcccanggctgntctgcaaagggcatcnganaatgcactnctgccctgtgtcngacanccctctccnnnncantanangaccctaaatc

SEQ ID NO: 10637 - DNA, 385 bp, Homo sapiens
  misc_feature 139: n = A,T,C or G
tacgagcagttcatctttgcagatcataccaatatgattcacgttgaaaatgtctatgaggagattttacatcagatcctgcttgatgaaactctgaaaggtaagaaaggttacctggtgctgcagggacactccatanaggggagcatccctgaaataggactcggtaaggccagtcagggaggaaaagagaagaggaaatggacattggtgagggagggagacagacagtgaggagagggaaggaaagaaggaaggatactaaccttgattgagtgttatgattaagcacacacaaagctggcactttagatgttattttccctttttaatacacaaatatgaatgctgtgagatgggaattttaagtttcattttacagatg

SEQ ID NO: 10638 - DNA, 353 bp, Homo sapiens
  misc_feature 9, 13, 15, 30, 31, 37, 56, 57, 63, 65, 72, 75, 94, 100, 105,119, 126, 139, 176, 177, 185, 191, 194, 229, 236, 241, 266,285, 297, 301, 314, 317, 319, 323, 324, 331, 337, 343, 348,349: n = A,T,C or G
ccgatgaangtgncntggcaaacgctgccnngaactntggctttgccttcctctcnngggccnanaccaccntcnccatcgctgaactgtgccntgaaangactnacaatgttcttgcngttgtgntcttcatcagtgnccggaagcggaatgagctatcattgttctgaacctcnnaaggcggnatcacnctntactgtaacggcgctgacactgttatttatgagcngttacanccaangaatccttctaaccaagaaacacangatgccctggatatctttncaaatgaaactnttanaaccctatgcctntgntncctnnaatttgnacaganggaatntccanngtgg

SEQ ID NO: 10639 - DNA, 645 bp, Homo sapiens
  misc_feature 1, 9, 488, 502, 510, 515, 531, 551, 568, 571, 578, 598, 600,601, 614, 615, 625, 626, 637, 640, 644: n = A,T,C or G
nacgacagnagggtgactctttggcaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcccccaaaacntataaagaatatgnctattttntatgngggaactgcagagccntggattcctaaaaaaaaggntctctttttctggatcntancaatgcntttttccctccttccaaccntnnctgtggttccaannccccctgtcnnttgaaaaaaanaanaaang

SEQ ID NO: 10640 - DNA, 415 bp, Homo sapiens
atcactcctatcctaacccagagtacgacaactggtgcaaacaaactcaagtgcaaaggaaacgcgacgaagaacttgccaaatctatggccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgt

SEQ ID NO: 10641 - DNA, 760 bp, Homo sapiens
  misc_feature 2, 3, 11, 13, 16, 21, 32, 43, 45, 61, 64, 71, 76, 89, 636,672, 722, 729, 745: n = A,T,C or G
tnntttgaccntncgntaaancttgcttgttncttttggccgnancggcctaggctgcganagnagacagnagggnattacccacttgnagcttaagtatatgtcttttacaatttattgtctatttcatgctgacgtgaggtttgatgtagacagtaaatagattaagcgtccttgggaagaaatgcttataggctaggcgtggtggctcacacctgtaatcccagcactttgggaggccaaggcgggaggatcgtttgaagccaggagtttgagaccagcctgggcaacatagtgaaaccccatctttacaaaaaataaaaaaaattcactgggtgaggtcgtgtatgcctatagttctagctacttgggaggctaaagtgggaggattgcttgaaccctggaggtggaggctgcagtgagccacgatcatgccattgtactccagcttgggcaacagaattaaaaacaaacaaaaaaaagctggtcaggtggagtgggtcacgcttgtaatcccagcactttgggaggctgaggcaggtggatcattttgagttcaggagtttgagaccagctcggccaacatgatgagaccctgtctctaccaaaaaattacaaaaattagccaggtgtcgnggtgtgtacctgtatcccagctacttggaggctgangcaggagaatcgcttgacccaggaatagggctgttgtaagtggagatcgnccactgncttcacctgggcacanacgagactctgtccc

SEQ ID NO: 10642 - DNA, 320 bp, Homo sapiens
actgtcttgaggcctcgctttgtaaaagccgcaaaatccaggtattttacagcaccaatctccttagccatagctagattctgcggatatgtgatgggattcagcttcttctacatcagtttctcgatccagggcttatcatccgccagattaagtttagctccactaagatgaatgcgagtaatcgcccagtggtgcagcacctcaggagtaccacatttggacggacattttcaaactgatggcatgactcagcccggtgacaagcctatttcgaacacatctggtttccgtatagatcaggggacgaaatccgtcat

SEQ ID NO: 10643 - DNA, 444 bp, Homo sapiens
cactcttgcactcctgtaatgagcctggcactgtgatgaaacacttttcccgtgtcgtttgagtgcatcttctcaacaaccctaggagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaatccatatattatgccgaa

SEQ ID NO: 10644 - DNA, 778 bp, Homo sapiens
  misc_feature 2, 9, 10, 13, 22, 33, 46, 59, 123, 210, 714, 725, 735, 764: n = A,T,C or G
gntttgaannccnttgtttcgnatcctttttgnaggactctgaagncctttgttcggcncgagaagaaactctgcctcagaaaatgtttacagcttccagtggaatcaaacataccatgaccncaatttatccaagttctaacacattagtagaaatgactcttggtatgaagaaattaaaggaagagatggaaggggtggttaaagacnttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactgggaaatatttttaagtggaaccaaaataggcatcccttaccaaatcaaggaagactgacttggacaccgtttggaaaatgggtaaaaacggtggnttactggtganttggggagcnagaaccggacccactggtatactggggantaacaatttttttc

SEQ ID NO: 10645 - DNA, 712 bp, Homo sapiens
  misc_feature 39, 451, 524, 538, 547, 600, 620, 627, 644, 662, 670, 691,693, 695, 698, 711: n = A,T,C or G
ggcacgagcacaaggagaagaagttaattaacattgaangatgagaagacatcttggaagaacttgaattgggccttggaagaagaacagccattcaaatagatagaattgtggtagcaaaggcatagaggtaggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtactttaggaattttaaaatgtggatcattgtactactaataactatttattttatatttactatctactaagtaatttacatgtattttcttgtactgactgtaaaccttctgggtgtgggtgttttaagtgccattttactgatnaagaaactgaggcttaaatagttgaaataagtcaccctgttagtgagtggccagaatgacaagtcagatctanggtttgtctaactnccaaagatnatataaaaataatggatctctccttttcccttatgcataaaatatggggagcntttttaaatcattacccatncgattgnccaaaaaaatacctttngggaaaactgattattantattccanaataaatttcaacggcctgcntngnctnctttacaactttnt

SEQ ID NO: 10646 - DNA, 429 bp, Homo sapiens
  misc_feature 2, 9, 12, 41, 73, 76, 78, 227, 231, 234, 236, 241, 242, 260,264, 274, 277, 284, 289, 312, 313, 314, 323, 324, 326, 343,345, 354, 374, 383, 392, 395, 404, 411, 423, 428: n = A,T,C or G
gntgaaccnaangacaagtagacaccacatccatgtgtttntgatgcacagtggaaattggggtaccactggnatncntttggtatggcaactttttcatcacttgttttatgtagttgtctgatcaattgtgaaaacataatgaatgttgggaaatggaacagtaaaataacgaaagccaactttttttttttttttttttgaaacggatttttgttttgtccccnaggntgnantgcannggcccaatctcggttaanttgnaagctccgcntcntgggttnacccnattttttttgcctaaacctcccnnntattttggnntnaacatggcccccgccancncccccgggntaatttttttgattttttanaaaaaaacnggggttttnccngtgtttaanccagggntgggttttcaantttcnt

SEQ ID NO: 10647 - DNA, 617 bp, Homo sapiens
tacttgttctttttgcaggatcccatcgattcgaattcaaggcctccaaatttatatctaacattgtttatgttatgatttttttttaattgcaaagactaggtgtatatttttttctgtttttctaaatgacccgtggtacttaataggtgtactaaaattgtgttgggagcagggatttgaaaatttctgagagatgtgtacttaatttagtaattctgtttcatgagatatgatctgttatgctagaggtttaataggcttgctatgtaagtagaacgtggctcaactagatatctttatatgtatgggcattactcttagtgatatttgtttcctgtcctttgttgctcatgctgtttaagtgcaggctgagacccaacctctttgtaagtacagtaaaataatccaccgttttttacagaccctagtcaaagggttaaaaaaattaagattgctttccatgtttgaaatttaccattgagagtcaatgaagttgctattttgagtttaacattgatattgtgaaaataagtgcaatttggattacatgtttcttaatattcattcttgtttcacaaatgaatgattaaggaattatgcatcataaaggaacc

SEQ ID NO: 10648 - DNA, 551 bp, Homo sapiens
  misc_feature 87: n = A,T,C or G
tacgaatttaatacgactcactatagggaatttggccctcgaggccaagaattcggcacgaggcagaactccagttctccgacccanaaaaagcctggcctcactctccacctccagctcagcactcaggcctggcaggccaccggctgcagaaagatcctcctccccttccccacccaagcagttgtgtttcccagcaaaaaatcggaccctcagctgctaccgcagccacatgatccactcagtgactcacaggcaggccacaccccttcaggcctcccggccaggctctgctcccagccagctaactctgggatgcatcttattaccaaagggaacaactagctaactaatgcccttgacagtccaaataattactttctttcattagaagaacttgcttataaaatatatacgggctgagaggacgcaggctcttctgaactctggctctgccagctctccaagtcctcccccaccatgccaagacctggggaatggcagacatggttagctgggaagctagaaagctaagacattcctgtttaaaa

SEQ ID NO: 10649 - DNA, 537 bp, Homo sapiens
tacgaatttaatacgactcactatagggaatttggccctcgaggccaagaattcggcacgaagggaaaaatttaaatttatattacaacagtggaatataatgtttaataacttgtgttggggggattatgtgttttgtttgtttttttttttacctcttcaaaaaattaaaaataatgaaaattttaaatcatcccaatataggtactttctgcttttttaaatattttggggcctaaatacctacttgaaattatgtcataaacctaaacacgtattctaaaaatggtaaagtacccttctagtaaaatatatatacaagttgttgatcatttgtattacctttttgaaattgctgaaaacaggttaaaaccttaggtattaaacgttgaatttaaagctttaatctggtaaaaacatctgtactctgattataattttctaatttttaagtatattaaaaaatataattgtattgcatgagtaaatacaagggaattataggaagccaaaattaatattttcaaaggggctggg

SEQ ID NO: 10650 - DNA, 503 bp, Homo sapiens
tacgaatttaatacgactcactatagggaatttggccctcgaggccaagaattcggcacgaggcagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacag

SEQ ID NO: 10651 - DNA, 72 bp, Homo sapiens
gattacgaatttaatacgactcactatagggaatttggccctcgaggccaagaattcggcacgaggaggaat

SEQ ID NO: 10652 - DNA, 190 bp, Homo sapiens
tgggtaccgggccccccctcgagatagtctctcctcgtgccgaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctca

SEQ ID NO: 10653 - DNA, 280 bp, Homo sapiens
agcttttgcaaaaactatttaggtgacactatagaaggtacgcctgcaggtaccggtccggaattcccgggtcgacccacgcgtccgctttgttctgttatacaaaatcattcattatgagcaggaaagattgatgataccaccatgaaaaataggatgtttaccccaaaacaagtgtgaattaagaatttgaacacaaccacattttttaaaatgaaacttctatcggaagtaaattaatttggtgtaataaagtccagtatttaataaaatgtacaat

SEQ ID NO: 10654 - DNA, 558 bp, Homo sapiens
aagcttgcggccgcctgcggctcatccaggccgtgcaggaagccgacctccacccgcttcagccgcttcacctgcttgcgccgccgcggccggtacttgtagttggggtggtcctgcatgtgctgcacgcgcagccgctctgcctcctccacgaagggcagcttctccgccagcgtcagcgccttccacgacttgcctgcacagtggaaggaagggggagaggggcgcagggcttatcggctgcgctcccgctccaggccccacctggccccacctggacgcacctcccccctcagactttgaattgcgcaaccggggtgaagttaaagagggagatctgggactcctgagtccgagcccttggggaacacccgtcctctaaaggcacccctttcttttggtctcctggaagcggctttccgctcacccatcacccggtcgttcgaaaaacagaaaaggacacctaactagggaaggggtcgagggatggacacaaccggcccagttcaaggccaagggtgctctcgcgccgcccggaggtgccgggaagtcgccttc

SEQ ID NO: 10655 - DNA, 510 bp, Homo sapiens
ctatgacatgattacgaatttaatacgactcactatagggaatttggccctcgaggccaagaattcggcacgaggcagacatggcctgtaataagagctaattaagtgttcactgttataatttctcataactacagagtagtttgatatttcagggagaaataatatatgtttgtttcccactgctttcacaacaaccctatgttgtaattagcactgttccactggcacctaaagacacggaggctctgggagatttctggccctaggccacgaaggcccacttgggactcaagctgaggtcctgtgattccatttgggagcaggaggagggatttgcaggtgatcttcctgggcctcctgagagcagctcaggtgcccaagatggactcaggcaggcagctctgctgtatgtgaagcccagtgaggggcagtgggggggccatgctgcaggtacaagttaatctccctgtatcgcctctgcccacttacccttactcctttttctac

SEQ ID NO: 10656 - DNA, 192 bp, Homo sapiens
ctccaccgcggtggcggccgctctagaactagtggatcccccgggctgcaggaattcggcacgaggccgtaggcagccatggcgcccagccggaatggcatggtcttgaagccccacttccacaaggactggcagcggcgcgtggccacgtggttcaaccagccggcccgtaagatccgcagacgtaaggcc

SEQ ID NO: 10657 - DNA, 296 bp, Homo sapiens
tctaatacgactcactatagggaaagctggtacgcctgcaggtaccggtccggaattcccgggtcgacccacgcgtccggtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaa

SEQ ID NO: 10658 - DNA, 432 bp, Homo sapiens
tctaatacgactcacttatagggaaagctggtacgcctgcaggtaccggtccggaattcccgggtcgacccacgcgtccgcaagggttctctgatgttttgttttctcacccatactttaaaaacaaaatgagtaataattaggaaagctatttttcagaggaggaaaataggatctttccattgtgccacaacactcttacagtttactttctgataaaacacagagaaactttgctttcttaccacgtggtccaaggaaggaccataaaccactggagtcagccctctgggtcctccctgctcctatcctgctgctcacaggctggatggccttgagaaagacccattaatctttgtgcctgcagttttgtcaactgtcaaatagggacctgtattttataacctgaagattagtcagtctctgttcttt

SEQ ID NO: 10659 - DNA, 412 bp, Homo sapiens
tatgacgtcgcatgcacgcgtacgtaagcttggatcctctagagcggccgcctactactactaaattcgcggccgcgtcgacgttttattagaaacttaaattctcccaagataggcatgatttgtaaatgagctagctgggaagctgggataaaatatttaagattcattgattttggctggtcaaacatgccccattcaaatagggccgccttcaagttctcaggctgagaccccactatgattttagcttttaaaaacttagttgacatctcaagtatgttctcacttcatgcttccagttatatatattattctattgtcccaaacgtaataggtccagaacaaaaatattataatatcttactccacaatagctcataatcagaactacaaagtttggaattttatc

SEQ ID NO: 10660 - DNA, 641 bp, Homo sapiens
  misc_feature 468, 557, 594, 615, 625, 626: n = A,T,C or G
attaattaaatctcttgaaatctcttttaggtatcttggaccttgttatgctgttgcttacttaaggtttatgactctcttattctcaccggcattatccatatatcattgttaactctaaaacatctccagcacagaagaagacaattttcactcttaatacagtataatatattcatagtgagccataaaattattttgacagtaaagcaatgtcaattttgaatctttgaaaccattatatacttcatagatttaatgtcttgaaatatttaaacaggtttgagaagtattattgcaactgataccttacatggattgtcttacaaaaatcagtacagaattatactgattgataaatgttcacatatataagaaatagtttgttgactggagcattcagtttccattgtttgtattcatcttctagtaatacaatatgcatttctcaaatgccctaatccgttntgaccatggtgcattcagtaacttctaggaagcattccactctgaaaaactgcataagcagatagattcttggaggatgcagctaaagntcgtgtttctatattgccactccatatttttcagtgntctttagtgcccatcaaaatntatttccacnnagtttatctcttgta

SEQ ID NO: 10661 - DNA, 399 bp, Homo sapiens
  misc_feature 300: n = A,T,C or G
cgcggccgcgtcgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggaccaactggatggcgtcacgcggccgcgaatttantagtagtagtcgacccgggaattccggaccggtacctgcaggcgtaccagctttccctatagtgagtcgtattaaagcttggcgtaatcatggtcatag

SEQ ID NO: 10662 - DNA, 730 bp, Homo sapiens
actcttaacaattattttattttaaaatagacaaactatgaatggtagaaaatagtaacatagcaattttaaatgtacagttttaaccaatacaaaaaagcaataaagcaataatatctgaagcattatttaagaaatctcaatacacgatctctgtagttcctaaaattctggcactaattctaatgtgaacttagtagcaaaagacccagaaatagtaagcccttgacctaaaaactaactgatttgtatgatattcatgcagaaacaatgatgaaatggagtcaagttttctagtgtcattgttatcaaaataactgtcaaaatagtaagtttgaaacttaaatgagcacaaaataaaattttgttttctaacaagaccagatttctttttaaaaataattctgagttagacaaagtgattttcctaaaagctagctgaagctaccttaaatatcccctattttaagttacagcatctctaaataagtgaatcacacaagatagtttaaatacacctttaggtgtaggggaggggagaagcgcctcgttttctgatgcagcgtgtttgatgtgaagcttgtgcacaggatcagatagaaacattaatgcctgacccatgatgacgcttgattacttgtaatgttgcactagaaataatgtggctgtgacatgccagtgttagaccatactgacttacgaaatagaagataaatggacagtggccagt

SEQ ID NO: 10663 - DNA, 601 bp, Homo sapiens
tatgacgtcgcatgcacgcgtacgtaagcttggatcctctagagcggccgcctactactactaaattcgcggccgcgtcgacagcagtggtaaccatgtgatattcggcggagggaccaagctgaccgtcctaagtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaaataaaccctcataaatattctcattgtcaatcaaaaaagtcg

SEQ ID NO: 10664 - DNA, 747 bp, Homo sapiens
  misc_feature 2, 12, 13, 17, 25, 28, 39, 41, 57, 60, 67, 72, 89, 667, 683,686: n = A,T,C or G
antacttgggcnnaaancttgcttnttncttttggccgnancggcctaggctgcganagncgacagnagggnattcattagtagtcagnataagcataaatcagtaaaatctctttaaaattttttctttaggaggttacatttcaaaaatttcaattctgattcctaggattgggtaagaaagtgggggaaattgatattcttaaatattgttggagactgtatacactggtgcacttgttttggaagataatgtggcaaaaattatcaaagatcatataaatgtttatgccctttgacttaccaattcccacctttattaatttatctcacgggaataattgtggatatttgtaaatatgtatatacaaggatgttcatcagaacatcatctcagtatggaaaaacttgtaatgtcttaaaggcacatcagtaaggattggttcaatacatgtccagatactctgaagccatttgaaaagttgtgcaagaatattttatgtgggaaaatattcacgatatattgctaagtaaaagattatgaaactataggagtttttatttacaaatatactggctgtgtgtgtgtccatgtatgtatgtatatatgtatatgtgtgtgtgtgtatatatatatataaatacatcaaaaataaacatatactantatattgatgttggtnggnggatttattggtaatgctgctctcctccaccacccccaagtccacccacctttgaactttc

SEQ ID NO: 10665 - DNA, 775 bp, Homo sapiens
  misc_feature 719, 750: n = A,T,C or G
acgacagaggggagctgagcggcggaacccttcgctggcgggagcgcggttcggggccgcagaggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaacttgaagaggaagaaacctccccgggagctgaatctgaaattgagcgcttcagaacgaatggctgaatagagagctaganaggccttcacaggagtagatgactgtcccanctggtctgagcctgatgagaaaaat

SEQ ID NO: 10666 - DNA, 62 bp, Homo sapiens
tttgcctgctttttttgttttatattacattttggttaaaacagtgcttgaggccgggtgtt

SEQ ID NO: 10667 - DNA, 325 bp, Homo sapiens
tttggagaatgagttcctgcctttagtggaagtggccagggcgttccggcagaaaaggagcagcagtctgagtgcggcaactcacgcctggaatcccagcactttgggaggcgtcaggtggatcacctgaggtcaggagttcgagaccagcctggtcaacatggcgaaacctcatctctactaaaaatacaaaacttagctgggcatggtagtacacgtgtgtaatcccagctactaggaggctaaggcaggaaaattgcttgaatccgggagttggaggttgcagtgagccaagattgtgccactgcactccagcctgggtgac

SEQ ID NO: 10668 - DNA, 672 bp, Homo sapiens
  misc_feature 1, 9, 10, 615: n = A,T,C or G
nagcccagnntaatgtgagctggtaaagggtattggaaaagtgccaagaaatgccaagcttttggttcgtaaccactataaaaagtttatgaacatgtcagaggaatggatgagtgatttgtgaggtcttaactagataacccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaangtaggggactgtttgtcttggacttcgctgccagtccttaaaacagtgtctgggacc

SEQ ID NO: 10669 - DNA, 625 bp, Homo sapiens
  misc_feature 118: n = A,T,C or G
ggttttgttttgttttttgagacggagtcttgccctgtggctgggctggagtgcaatggcgcgatcttggctcactgcaacctccgcctcccgggttcaggggattctcctgcctcancctcctgagtagctgggactacaagcatgcaccaccacgcccagctaatttttgtagttttagtagagatggggtttcaccatgttggccagatgatctgaatctcttgacctcgtgatccgcccgccttggcctccacaagtgctgggattacaggtgtgagccaccacacccggcctatattgttttgaaagcatactctatatatagttacgggcagaggcacaggcatcctcagcagctgattcaggagatgatggtaaagctatctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatct

SEQ ID NO: 10670 - DNA, 635 bp, Homo sapiens
  misc_feature 606: n = A,T,C or G
gcgccgccgagccgggtcccccgccgccgccggagcgacagcctgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtgcagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttactggtcagacccaagtagttgctaatgtgcctcttggtctgccaggaaatattacgtttgtgacaatcaatagtgtcgatctagattctttgggactctcgggcagtnctcagacaatgactgcaggcattaatgcg

SEQ ID NO: 10671 - DNA, 92 bp, Homo sapiens
tccaccgcggtggcggccgctctagactagtggatcccccgggctgcaggaattcggcacgagctgggccctgctacgctgcactgatgacc

SEQ ID NO: 10672 - DNA, 587 bp, Homo sapiens
cggcacgagggggcagcagacagtggtcagtcctttctttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcctggtgtcatcttcctaaccaagcgaagccggcaggtctgtgctgaccccagtgaggagtgggtccagaaatatgtcagcgacctggagctgagtgcctgaggggtccagaagcttcgaggcccacgacctcgggggcccatggggaggacaggacctgaccttggacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctc

SEQ ID NO: 10673 - DNA, 63 bp, Homo sapiens
tccaccgcggtggcggccgctctagaactagtggatcccccgggctgcaggaattcggcacga

SEQ ID NO: 10674 - DNA, 504 bp, Homo sapiens
caaggatagaagcttctcatttatttgggtactttccaaatgtatacaattcaaagtagaaaaataaaaacaaggtaaatcttataaaacacaaatgtttacaccaaaatggtcaaatcctatcatgctggaagataagactgtccacacacgcgcacaaacatccagagtttattgctcttcaccatggaaaaaaagtctcttcccgatgggtatttacaaagcggggagatggagtgtgaaattaaccagtgttgaaatcgtaccacccattcacatcttcaggacagtggcaggaacagcgccgtatgcttgagggtgctgtggtcacagctcgcggccccggcaaccgaggcccagttcccttccagtagtgggcagctcagtgaggctggatagaaagtctgggcaggcagtgggtaagcaattgaagcaagaagagaaaggagatgttcagagaaccaaaggcgcccttgtgaaggttccatctgtctcacaggaggt

SEQ ID NO: 10675 - DNA, 164 bp, Homo sapiens
  misc_feature 13, 21, 29, 43, 53, 59, 95, 110, 116, 119, 130, 142, 146,156, 161: n = A,T,C or G
gccttgcattagntctcagcnatggactnctgaacccagtccnggaaggaagncacctncacatacacaccatactcagccacagcacagctctnatcaaagcttaagancccagncgnataccaggagnccaacaacaggncgtnaacggcaaangcacngcc

SEQ ID NO: 10676 - DNA, 753 bp, Homo sapiens
  misc_feature 667, 682, 690, 724, 725, 734, 741: n = A,T,C or G
ccaggacactgccacttcctttaatacagcggtgcctccacgccccgcatccgatgcagtgttacacgtgtgtgtcgctcaaacatccatcctactgcacatactcagtttcggccagcaggggaggagccgaggtagctcccgctcccttgagccaggcccctgccagacctgagctccctcccaagcctggcttccccaaccggtggccttcatgggccaaaagccattccttcacggccagtcctccggagtagttgcccacggctccgctgctgcagaccactctgtggcacgggatgaggatggggacaggattgcctctcattgctcctcccactgctcgcgcggctttggggttgcctgccagggctgctaattgctggtaagaaatcacttctccgaatttcacaaccttcagcagcttccataacacctgtctggtgaacgactcttgctggaaaacgggatggtgaagagccggcacggggaactcttcgatagcctcgggctggtggaaataggcattcagccaggctgtgcactgcatcaggggctccggactccgagaaccgcagcgggggctgggaactccacggcatcagctgcagacgtccccttgccaggagctttattttcgtgcagacctgctcacaaacagacagcntcagcttccccaaangggctgtnccagtgtggtgcgtttcattttcacaatctttgnntcatttttncaagtancaaagtcgcaaa

SEQ ID NO: 10677 - DNA, 516 bp, Homo sapiens
  misc_feature 487: n = A,T,C or G
gtttgttttgtttttcctcgccaacgtgctcacagatctgatcctaaaagagtctctttttcccatgctttgtagctcggattgtatttctgctgggtgggctgctcctgtctcggccctcctccctcccacccagcctgcctggcccgctgcacttcccggtgtccccgcggctttggagtccttggcccaggtgggtcctctgagtctctagggggacggggcaggtgggaagcgcccaaggtctaggagcactggatggacatgtaaggccagttgaagctgctcccagacagtaacatatcgcggatgagagtttcgatgggggttttacctaccaaacggacgaagaagagctgctcgatgacggaggaggacacggtgcgcagcgagggcagtcgcagcagcagtttgccaaaacggctgggctggttgggtactggctcctcacgtactcctccagtgcgcactgcgacttctcctgcangctctcgatgtgggccgcattcgacaggc

SEQ ID NO: 10678 - DNA, 694 bp, Homo sapiens
  misc_feature 350, 523, 531, 532, 594, 595, 596: n = A,T,C or G
cagcttggcaacagatttattagttcagagtagaaagagcaagagtccaagtgctttgattgttcagtaaaaactatgcctcctgactggagagctgccagcctgctctcccccactcttaacaacttaccctactattaaggcacttgagaagagggagagcaaggaagtcccagaccaaaccccttctggatcctggagagagccagtgctgttgcactggtttccttcagccatggttgagcaaggaaagagccggcagagacctctgtagggcaggaaggccagcccctcaaacgctggtgttaggcacagggacaatgccagtgccatacaggggctggtatctngggcgttattttgattaagctgtaatgaatccatgatggaagacacttgataaggctttgtgggctcaaaggccttacctccagcctgcttctgtctctaggagagtaccagaagctggaggatgggggatgggaccccagagttccctacagagaaaggagctgaccatcangacagggnngaaaagttggttttcccagctcccccctttccagagaagttatgcttctgcttaagcacctnnncaaagagagagagatacagatcctggcaataaaagaattaaatatggctcccccctccagggagacatcccacaagttgggggcagtggacacacccc

SEQ ID NO: 10679 - DNA, 77 bp, Homo sapiens
ctatttaggtgacactataggaacaagtttgtacaaaaaagcaggctggtaccggtccggaattcccgggatggccg

SEQ ID NO: 10680 - DNA, 598 bp, Homo sapiens
ctatttaggtgacactatagaacaagtttgtacaaaaaagcaggctggtaccggtccggaattcccgggatatcgtcgacccacgcgtccgatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgaaaatagagttggtctgctgtgctaacttcatgtttcttattccaaaggcttgattatatttttttctccagtgattaaaaatgcagcgaaaatccaatctacaagttcatatattggtatttct

SEQ ID NO: 10681 - DNA, 163 bp, Homo sapiens
catggtgggttggctggcggtaatagtatatgaggaaccttttaaacgacaacaatactgatttctttcaggatgatttttaaaatatagaatggaatgtgttatcctctttgtgaaacgcttcctataactcgagtgtatatgggaacaaaaagctattggt

SEQ ID NO: 10682 - DNA, 593 bp, Homo sapiens
  misc_feature 555: n = A,T,C or G
ccgtgtccacaaggcactttatgcattcaaaaccaccgaattcacatccaggtttgctcagacagaggcccagaggcgaccccgctctggcgtggctaccacctgagcggctggcggccctggcccagctcggcctccgcgtaggcgtcatacagcaccttcaggtgcaacagcagctgctccaggttctcgccggtcaacgccgacagcacgatgacctcctgtcccaagtgatcccggagctgggacagattggcttgggcttcagggaggtcaatcttgtttgcgacgattgcgtggggcctcgcagacaggcccttttcatacatctccagttcatattttaaatcgtcaacttgagtccacggctcaggctgagaaagatccaccacgaacaagagaaagcggcagcgctcgatgtgcctgaggaaggcggaccccagacccctgttctggtgggcgcctcgtatgatgcccgggatgtcggccactgctatttgtaggtggccttcgtagtggacgatcccgacgtggggcttcaaggtggtgaacggntaggaagccacggcgggtctggcgtttgaaatggcctg

SEQ ID NO: 10683 - DNA, 731 bp, Homo sapiens
caatggtccattctgtttattcagaacggtaacataaatacaccttaaatattaacattttttatatacagaaatgaccccactccccaaaaagtttgaaaaaatattgtctcctcctcctttataaaaccctagatgacctatgaaggcacagccaagcccttgatgcatcttcctcagcacaatttggccaacgctggagggaaggtcaaagaggtggaaggaaaatgttatgctgaaaatccctttccaacaagggtgccaagcgccggtcttgaacgaagtaccctgcctaagcatcatttcctaaagcgcttgaagagcgggtgtacatgtttgctgggcgccttgctccgcgatgagtggtactccatgtacacagtgtcgtcggccccagacatagaactcatggtgccaaagcgccgagatgcctggctggatctggagccaaattccccagccaccacctcctcctcggcatccaggtcagtggctgccaggactttctgtaagagctgctgttgctcttcttttgtcgaaaacgccaagtcttcctcctccatgccagcgagtttcgtgatcaccttgaagctataaccttgatctaccaagaatctcttgcgcttggttgagtaagccattttctgtgtgtcctgggataccagtgagtagaaaaaggatttgtactctttctgcacccatcctttttttagttcaagcaacccccccta

SEQ ID NO: 10684 - DNA, 601 bp, Homo sapiens
cttcatggtaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctc

SEQ ID NO: 10685 - DNA, 669 bp, Homo sapiens
tggtgttcagagcctcaacaaaaccaaaggataaagggaagtataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactatgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaa

SEQ ID NO: 10686 - DNA, 357 bp, Homo sapiens
tatgacgtcgcatgcacgcgtacgtaagcttggatcctctaaagcggccgcctactactactaaattcgcggccgcgtcgacccacaactcaacggctacatgggaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgagccgaat

SEQ ID NO: 10687 - DNA, 175 bp, Homo sapiens
gtgaccctagggctggttttgaaactttaggtttttttgacctgtgggcctcggggcagaaaaaaaaccctaccagcgaaccttttttttggggttgtgggagaatccctgcaccccacttgaggggggggatttttttggtggaggaatcccctccgccgtgggtttggggttg

SEQ ID NO: 10688 - DNA, 678 bp, Homo sapiens
tccaccgcggtggcggccgctctagaactagtggatcccccgggctgcaggaattcggcacgagctccctcggggccggagagtggccctacaccagccagcgctgagcataatgagtaactaggtaggggcaggtgggtgatctctaagctgcaaaaactgtgctgtccttgtgaggtcactgcctggacctggtgccctggctgccttcctgtgcccaaaaaggaaggggctattgcctcctcccagccacgttccctttccttctctccctcctgtggattctcccatcaggcatctggttctcctcttaatgccagttgaagatggtcccttacagcttcccaagttaggttagtgatgtgaaatgcttctgtccctggccctacctccttccctgtccccacccctgcataaggcagttgctggttttcttccccaattcttttccaagtacgttgtggttaccctactccccaaatccctgagccagaagtggggtgcttatactcccaaaccttgagtgtccagccttcccctgttgtttttagtctcttgtgctgtgcctagtggcacctgggctggggaggacactggacccgtctaggtttttataaatgtcttactcaagttcaaaccttcagcctgtgaatcaactgtgtctcttttttgacttgg

SEQ ID NO: 10689 - DNA, 497 bp, Homo sapiens
tccaccgcggtggcggccgctctagaactagtggatcccccgggctgcaggaattcggcacgagcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataat

SEQ ID NO: 10690 - DNA, 492 bp, Homo sapiens
tcaataaatatttattataattaaaagaccgtagcaatacccccaccaccaagacccttcacccagaaatagagagattggaattgtaaacaccgtatccagttctgaccaccctgaaagccagggcatcatcgcgcccgttttgtcctaaatgaagggctcccggacaatgtcctgaaagtggcagatgacctcatcttccactgtccaccgggcacagggcagaccggggtgctctatggggtcctggccgatgcctgggtccaggggtgttccccaggtggtcaggcaaggacacgcggtcattctgcctcctgcgtcttgtcctcgggcgcctgggaccctctctggttccacatgtggttgttcagccccagctgtaccatctgtgcgtggtggataatgagggggttgcagccctgggctctgagggggtgccggtgaagccgtagggaaaggcttggggactgccgggaaaggcagtgacttttg

SEQ ID NO: 10691 - DNA, 769 bp, Homo sapiens
  misc_feature 1, 695, 697, 699, 730, 732, 745, 760: n = A,T,C or G
nacgacagaagggaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactaattggcacttaaattttttctttataaagcttttgaagtcataaacaagaccataattgatgatagacctaaacattcctctggggggngngnacattccaaactttttttctttccctggtgnangggcacatttaanttttaggacttttanagtcctaaa

SEQ ID NO: 10692 - DNA, 635 bp, Homo sapiens
  misc_feature 170, 171, 172, 174, 381, 451, 458, 526, 528, 549, 572, 576,600, 602, 613, 616, 622, 624, 626, 627, 630, 631, 633, 634: n = A,T,C or G
ggttgaattttaaggaattcattgtatcttttaatattctgaatgctagttatttgtcagatacatgttttgcaaaccatttatctgtatttggtttctttttgttatcttagcagtgtatcctgaagaatagttttaaattttgatgtaatccaaaatatttcggttgnnngngttctttgttatcctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaanggtttcacattaaatttaaacatacttatattttataaccaaacaagtcatgttggggcatactcattangattgantgctttcttacaccaaaatacatgtatacaaagatttaaaacactttcggccggcccgggaatcccancnctttgggaggccgaggcgggnggatcacaaggctgggagatcangacntctggctacacggggaaaccctgncnctcctaaaaangcnaaaatngncnnacnngnng

SEQ ID NO: 10693 - DNA, 762 bp, Homo sapiens
  misc_feature 695, 700, 724, 734, 749, 751, 757: n = A,T,C or G
ttatcgatcatattttagtgtttccatcccaagattccacatgttcttacacatgtcatcaactgtcaacttctcgcatgggttcaatttgtgatgaatgtttatatttgctaggttctactgatccacttctgaattacccacttgcccctcgggagacacataatgattttagggtgaggaaaatgctgctagaaaagggactttgtggctgggcgcggtggctcacgcctgtaatcccagcactttgagaggctgaggcgggcagattatgaggtcaggagatcgagaccatcctggctaacatggtgaaaccccatctctactaaaaatacaaaaattagctgagcgtggtggcttgtgcctgtaatctcagctacttgggaggctgaggcaggagaatcgcttgaacccgggagtcggaggttgcagtgagccgagattgcgccactgcactccagcctgggcgacagagcaagactgtctcacaacagaaaaagaagaaagaaagtgactttgtttgggctgcccggcaacggatcccaagatagtgattccagagcaagttgttacgtggaggtgaagaaaaccctacagggctgaggttgggagaaaaagcagtcctacagaagtgtattaagcaagtcccactggactgttaactttctccatggagaaatcctggagccccaaanaccancttaaagtaccaactgggcgcagnacctgaatanttgcccacttcccancnccttgngctgt

SEQ ID NO: 10694 - DNA, 690 bp, Homo sapiens
  misc_feature 1, 15, 581, 600, 614, 615, 620, 628, 637, 639, 661, 662,673, 678, 682, 685, 689: n = A,T,C or G
ngggttttttcaagnatggagtctcgctctgccacccaggctggagtgcagtggtgcaatctcggctcactgcgacctccgcctcccgggttcacgtgattcccaagtagttggaactataggcgcatgccaccacgcctggctaatttttgtatttttagtagagacggggttttgcagtgttgaccaggctggtcttgaggtcctgacctcaaatgatccaccagcctcggcctcttaaagtgctgggattacaagtgtgatgaccttgggcccctcccctcctttctccatcatggtcgtggtggtggggctattgaccttttaagcaatatttttgaaacaaaaaattatgtctaggatggagttatttggtttctaagcctcagtgagcccttcaccaaaatggcttgtagtgttttggaggatgtagacattatattcctatcatggcccaggcgaggtggctcatgcctataatcccagcactttggcaggctgaggtgggaggattgcttgagaccaggagtttgagaccagcctgggcaacatagtgataccccttctctacaaaaaataanaaagttggctggacatggngcacctgcctgcanncccanatactcangaggctgangngggaggattgcttgaccccggnnggggaggctgnctganctgnatntacnt

SEQ ID NO: 10695 - DNA, 374 bp, Homo sapiens
attcatataaaaggaaacagacaaacataacgctgtgcatgtattctctcttagaccagaacaggcataggatgcacttttaatttgtccatttcgtagagtagaaattgtttttgctgaaatgaacaccttaggatgctgaagaatatgacccgtcccatggaaaacattcaaaaatgtgtgtagcgctttcttcccaagggtgtgtgtgcgcatattttaacactaattcactttctacttccgttgctatcctttctgtgagtctttctcagaatctcagaaaagaaactaaattgttcactctagttatcaatgctgtactctatacctggaatttgctaaaagggcagattttaagtattctcaccaca

SEQ ID NO: 10696 - DNA, 670 bp, Homo sapiens
  misc_feature 537, 571, 577, 594, 605, 609, 618, 628, 640, 654, 655, 658,659, 662, 664, 665, 667: n = A,T,C or G
tgagctatctaggaatggagaagatattagtactgtttacccaaagtactggagtgtgaacataaaggtttgaataagaccaagttggtaatagctattaatgtggaagtatgtttgttctctgtgcaaattggcaaaatttaatttggctttgagaaaaagagaaatgctagtagcaggttacttttgttgccagttgagagaaaaattcaagtagcatttcatgccaggagagtattttactggtgttagagtggaagtggggagtgctcatggatctgcaggtcacaccaccaaaccaggatttactgattaataatggagacaggataatttttggcctcattaggaagaatgaagatgagaaatgtagactatgccttcaggtatgtctgtcctacctcaattttaagtgtacaaggaatcttttagattaaggtttcttcatgcctgcctgcctgcctgccaacataataagctgtaaaaccttgtttagttttccttaaatccagaaatgattctataccaaatccttcnaatcgaatcactcttaagggagtaagtgaaaacntgtgtntctgccttgctggcttntctatttgcanatgnctcattctntttgctaacnaatttcttaacntccttgatgacctnntcnnttngnngnaat

SEQ ID NO: 10697 - DNA, 850 bp, Homo sapiens
  misc_feature 2, 11, 13, 16, 20, 21, 32, 43, 45, 52, 62, 65, 72, 77, 101,627, 642, 644, 688, 690, 718, 779, 780, 788, 804, 809, 838,839: n = A,T,C or G
anatcttgggntncgntaanncttgcttgttncttttggccgnancggcctncggctgcganagncgacagnagggnattaaaagttgtagccatctgagnataggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctagattactataggtcatttgatattggtttatggtgcttttatttccttaacttgaaaacatctttctgagatttcagagtcctcaaatttcttanattaagagacaagangncagtgcagtggttcacacctgtatcccacactttgggaggccangngggtggatcatttgaggtaggagttganacaacctggccacatggcgaatcctctctctactaaatacaaaattacctggcatgggggnngggcctgnatctcacctctgggangctgngcaaaatgcttgaccagagggggggtgcnngacccaatccc

SEQ ID NO: 10698 - DNA, 187 bp, Homo sapiens
  misc_feature 17, 21, 43, 50, 62, 65, 71, 78, 82, 90, 91, 100, 101, 119,161, 171, 172, 175, 177: n = A,T,C or G
gggttcggctgctatangacnaccgaaggtacggctgctatangacgacngagggagtgcanatncttgancccctcncccngctgctgnnatcttatcnngaagctgttgatctcctnttccacgtgctttctatctattgggaaacggcctttccctgngttgattgcnncantntttttttaga

SEQ ID NO: 10699 - DNA, 280 bp, Homo sapiens
tgacttttatttatatgtgcacattctttgggagggtgttaggactctttcggttgcaagtgtcagaaactcaactcaaaggagcttaaacaagcaccagaagttaccgggtcacacatctgagatgcccaagggagctcccaatcaagctggatcagcgagtcaaaccgtgtgctcaggaccctttcttgctaggtcatctccctgtggggagaccaactgtcccagtttgcccaggtctgaggggcagtcctgggcatgggaccttgatgggtacaac

SEQ ID NO: 10700 - DNA, 745 bp, Homo sapiens
  misc_feature 5, 21, 582, 618, 650, 733: n = A,T,C or G
acagnaaggaggaaacccagnagatgtggtagtaggggttgtgagggggcgctgtggggccatgcctggtggagatccaccacgttaagccttctgctaactgtttgtctctgactccatgatctcttctgcctcttcccattctggattctgctcatctcaggttgctggtcaaagcttcctgtttatatttagagagtgtaagaagagtaagaacccttttattgccactgacccatattcatatttaatgttgcttgtgttagtcggctcctcattggttctctttttggaagcaagcagggacttagagagtccagaggaagctcagagggctggagctttagttcaggttggctgaggtgcttgttcttaattcttctgtgacaccatgtctgtctcagtcactgcatttttaacattgttttgaaaacatttctcggccaggcgcggtggctcacacctgtaatcccagcactttgggaggccgaggcaggcagatcacctgaggtcaggagtttgagaccagcctggctaacatggtgaaaccccgtttctactaaaaatacaaaaaattagctnggtgtggtggcgcacgcctgtagtcccagctactcnggaggctgaggcaggagaatcgcttgacccanaggcggaagttgcagtgagccgaatcgcgccattgcactccagcctagtgacagactgaactgtctcaaaaacaaaaaaacanaaaaaaaaaaac

SEQ ID NO: 10701 - DNA, 786 bp, Homo sapiens
  misc_feature 13, 14, 15, 24, 30, 36, 45, 48, 50, 66, 69, 76, 630, 642,712, 714, 748, 764, 767, 768, 781, 784, 786: n = A,T,C or G
acaaacttggggnnnaaaaacaancttttnttgttncttttggcncgnancggcctaggctgcganagnagacagnagggcagggctctcgccactcacactttcattcattcactcattcattcgttcgcccattcgttcattcattcaccggcccgcccattcattcattcgttcactcacccattcgttcattcactcgttcattcattcactcactcgttcattcgttcacccactcgttcattccttcactcatttgtttattcgctcaccctttcatgcattaattcactcacccattcgttcattcacttattcattcattcgcttgttcattcgttcattcactcgttcattccttcacccatttgtttattcgctcaccctttcattcattcactcattcatttgttcacccattcacgggctcacccattcattcattcattcattcgttcatttactcgttcattcgttcacccatttatttgctcactctttcattcattcattggtctcacccatttgttcattcattcattcttatgtgacccattcacttattcattcccacaccattccttcctgcattcactcattcctgcattcattaactcactcatttgntcatccatttgntggctcacccattcatccattcattagctcactcacccaccacattaacacataaaaccctcattacacnanaaaacccctctggtcataacctatcccccatttnctctatccttaacccnacnnattaccgggtttnctntn

SEQ ID NO: 10702 - DNA, 590 bp, Homo sapiens
  misc_feature 516, 525: n = A,T,C or G
aagactggcgtccaagactggaacaactcagtctcgctctttccgaatccttgcccagatcactgggactgaacatttgaaagaatctgaagccgataatacaaagaaggcaaataactctcaggagccttctccgcagttggcttcctcggtagcctccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcaggagaattgcttgaacccanaaggtgaangttgcagtgagccaagatcgtgccactgcactccagcctgggcaagagagtcagactcccatctc

SEQ ID NO: 10703 - DNA, 115 bp, Homo sapiens
agtggatcccccgggctgcaggtggtcctgtgcggtcacttatccaacatgcctgaggaaacccagacccaataccaaccgatggaggatgaggaggttgagacgttcgcctttc

SEQ ID NO: 10704 - DNA, 253 bp, Homo sapiens
acccaccatggagctgtctcctgccgacaagaccaacgtgaaggccgcctggggaaaggtcggtgcgcacgctggcgagtatggtgcggaggccctggataggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtcc

SEQ ID NO: 10705 - DNA, 579 bp, Homo sapiens
aagcttgcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatga

SEQ ID NO: 10706 - DNA, 375 bp, Homo sapiens
gcgaattgggtaccgggccccccctcgaggtcgacggtatcgataagcttgatatcgaattcggcacgagcagaaattgtgtatgttagtaaattgcgtatgttagtaaatacgttagtaaataagggagaaacttgatatctatagttccatgatgatactgacaacctcaaagttcttgtctgtggtggttatttggattctggaaaactactgtgtgtttctgttgtcttgatctgaatgcctctcaagaatgacactttcttttaagagctttatctctacaagctatgtgttttaagaactctggggatgaataatcacacagtgtgctgacttaggatatcgttgtgcataaggctgtttttttttttt

SEQ ID NO: 10707 - DNA, 87 bp, Homo sapiens
gtaactgaaaatatcttgtttaagctctctgaaacttacttgatggaaacctgtgagtcttgggttgagtacccaaatgctaccact

SEQ ID NO: 10708 - DNA, 459 bp, Homo sapiens
ctgaaaacagattttagcctgataggttgttcctctatttgaaagcctttacaatttcggagggaagtttccaaatcaatcagtaagtaccccccactccaggtttatccttatgtaaagtgccccctttgcacatgcaagattgaataaaccttgaaaatattatgctaagtgaaagaagccggtcacaaaggaccacatggtatgtaattccatttaaataaaatgtccaaaatagaccaacacatacaaacagaaagtacatttgtggtggcccaggattaggggagttggggggaaatggagggatatggtgtttacttcagggtaatgaaaatgatctaaaatttattgtggtgatgtttgcataacagtgcaaatatactgaaaaccactgaattttacactttaaatcagtggcttctgtggtatgttatcaatatttctcaataaaacttc

SEQ ID NO: 10709 - DNA, 518 bp, Homo sapiens
tcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcgatcatgctgagcgtcctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaaaactcccat

SEQ ID NO: 10710 - DNA, 150 bp, Homo sapiens
ttcggcacgaggttggtgtgcacctgcaatcccagctactcaggaggctgagacaggagaatcacttgagcccaagaggcacaggttgcagtgagtcaagatcatgccactgcactccagcctgggtgacagagcaaggctctgtctcaa

SEQ ID NO: 10711 - DNA, 603 bp, Homo sapiens
  misc_feature 547: n = A,T,C or G
ttcggcacgagggggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagaggtatgtctcattagcatgacaactctttgtcttccttgcttgtacttttgctgccacgttggaacctggaaaaatgcatgtaattaggaatgtgctggttatgctgctttcaacatgaaaccttagttttcataggaagcaganagcctatatcaatctgttagcacttgtttacatacctaaccctacttggagagcac

SEQ ID NO: 10712 - DNA, 628 bp, Homo sapiens
gcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgtgctccccactgagtgccaagggtc

SEQ ID NO: 10713 - DNA, 731 bp, Homo sapiens
  misc_feature 5, 363, 368, 385, 425, 457, 487, 531, 540, 584, 608, 629,636, 638, 645, 655, 678, 689, 690, 698, 702, 704, 708, 713,715, 718, 729: n = A,T,C or G
aaagnaatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaatgacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgngaggntttgctttttttgttgncagctatcttaagaatcattaaatacacctgctttgggtnaaactctttgcaagcagtaattaacactagtnacagtgaaagcacaagatttccaaatcagncggtttctcaaaaaaatatcgtataagtgactcattctgtctgntaactccanacctcccagcttggagccaaatcttttcatgtgagaatgatatngatttcctaaaaaactgggaaggnggcatatcttggcccattttnattctgntntaaaaanaatggcttcncttttaaggggaattggaattanaaccctgggtnnatttcttnaagngntaanaaaangnggncccaagaacantg

SEQ ID NO: 10714 - DNA, 622 bp, Homo sapiens
caagctacttgttctttttgcaggatcccatcgattcgaattcggcacgagacgtggcgacccgctgaatttaagcatattagtcagcggaggaaaagaaactaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatg

SEQ ID NO: 10715 - DNA, 275 bp, Homo sapiens
  misc_feature 13, 21, 31, 32, 53, 60, 65, 80, 90, 94, 102, 111, 115, 119,123, 140, 157, 166, 175, 183, 184, 197, 205, 216, 221, 223,226, 230, 232, 235, 245, 256, 272: n = A,T,C or G
taagggtacatgntgctatangacgaccgannggtcctgctgcttagaagacnacagaanggtantgctgcttataagangacagatggntacngctgcganaagaccacngtangggnacgnctgactgaagactactntaagggtgcgtgctgcncagaagacnaccttgggntcagcttnnattaagacgactnaatggtcnggcttcgatgnagacncntgnacgntncgnctgccaatangtctacatatnggtcctgttttgtgantac

SEQ ID NO: 10716 - DNA, 787 bp, Homo sapiens
  misc_feature 3, 4, 5, 6, 9, 638, 653, 662, 690, 693, 700, 745: n = A,T,C or G
ccnnnncantcggccgagtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggttttgagttgttagggattttgagtttttcattttattgcatatctgggttggatggttagactaaaaggaaacccacggaatatttaccctgggggttacattttaatattttaatgnaactgggtctaaccnacctttaangggggattttttgaaaccccaacttccngangcttgtngggccttgcacaattttgcccctggtttttaataataccttgggnattcaatatccctctttatcaaccctcaaaactccaaaaccc

SEQ ID NO: 10717 - DNA, 268 bp, Homo sapiens
  misc_feature 1, 20, 23, 29, 54, 72, 74, 79, 86, 102, 108, 114, 140, 164,172, 173, 178, 197, 213, 219, 221, 222, 234, 237, 238, 249,257, 260, 262, 265: n = A,T,C or G
ngggtactggctgcgataanacnacatangggtacggcttgcgggattacgacntaatggtacggctgctancntgacnacataanggtacgggtgctatantacganacaatnggtcggctgcgtgatgaccactgacnggttcggctgccatgatgaccacncagtggtnnggctncgatcacaccacaaagtgntgctgctgcgattatnacatananngttacggctgcnagnncaccattgaanggtgcggntgngnganacg

SEQ ID NO: 10718 - DNA, 334 bp, Homo sapiens
cagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctg

SEQ ID NO: 10719 - DNA, 495 bp, Homo sapiens
ctccggaactaaacggggtgaggtcacattcggttatctctaacgttggaaaacgatggagctaacacccattatggagattaaccacttttcaccaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttat

SEQ ID NO: 10720 - DNA, 616 bp, Homo sapiens
  misc_feature 482: n = A,T,C or G
aagtttgtacaaaaaacaggctggtaccggtccggaattcccgggatatcgtcgacccacgcgtccgatttgtttcagtggtttggtgttagaactgctagaagggaatctcactatcttttcttcctttttgagatagtcttgctctgtcatcaggctggagttcagtggcgcaatctcgactcactgcaacgtccgcctcctgggttcaagcaattctcctacctcagcctcccaagtagctgggactacgggcatgtgccactatgccaagctgatttttgtagttttagtgcagatggggtttcaccatgttggccaggctagtcttgaactctgacctcaagtgatccacccgcctcagcctcccaaagtgctgggattaccggcgtgagccaccgcgcctggcgacttgtgctaacgttaaaccaaaattatggggggtcattttttgtggacggagtttctgcactaggtcctancagaccaaagtagttacatatattaagtgccacacagttacatggaaactttacagaccagtttttcctgaaaacagaaaatcccagtctgtctgaatcagaatataaaggaagtcccttcttctttaaccctt

SEQ ID NO: 10721 - DNA, 437 bp, Homo sapiens
tttgtacaaaaaagcagctggtaccggtccggaattcccgggatatcgtcgacccacgcgtccggtgagccgagatcgcgccactgcactcccgcctgggcgacagaacgagactccgtctcaaaaaaaaaaaaaaaaaaaaaaaaattttttttttttctaatttagcaaaagtgaattttggaattcccagaatttccagaaaaaagaaaaaaaccaaccttaaaaacttaaaactttacggggaaaaaaaaaaaccccaaattttataaattgaaaaagggacctttttgttcccaaagggaatttttcctaaaaaaaaacttttgaatgaaaattttgggaggaaaaaaaacttcccgggttattcccaaaaaaaaaaagcctccttaattaccaaaaaaattaaattttggggaaaaagttttaattgggac

SEQ ID NO: 10722 - DNA, 536 bp, Homo sapiens
  misc_feature 209, 442: n = A,T,C or G
aagtttgtacaaaaaagcagctggtaccggtccggaattcccgggatatcgtcgacccacgcgtccgacactactctctggaaagactgagccaattacggggtcatctgtaaagtctaagtgctgcagtttccctacgaccattggattttgtttgtagtttgatattgtcttactgtcccttgaagttgtaatttgtaattctttanttttcaagaaggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttangaggccaaggcgggcggatcacctgaggtcaagagattgagaccagcctggccaacatggtgaaaccccgtctctactaaaaaatacaaaaatt

SEQ ID NO: 10723 - DNA, 432 bp, Homo sapiens
ctggtaccggtccggaattcccgggatatcgtcgacccacgcgtccgccctactaaggcccagacctcctggtatctgccccgggctccctcatcccacctccatccggagttgcccaagatgcatgtccagcataggcaggattgctcggtggtgagaaggttaggtccggctcaaactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatccctt

SEQ ID NO: 10724 - DNA, 519 bp, Homo sapiens
  misc_feature 486, 487: n = A,T,C or G
gaaatacatgattatgttaatggtgaaggtgtcacaacatgcaagatgggagagttgagaagggtcacagaagaaattaggaatttccacatccttgaagcaggtcacttgtaaggcaatcaagttgtgcagctgggagtctaaaagactgagaaaaaaaaagacaacaaaactagaaaggcacagaaacacgggttcatgatggtgaatgatatagcgggtgacagatggctacaaaccagtcataggccatcacactcaggagcatgtctctcttccatgcctccaaaaatggcaaagagagacatctgagtcaggcagcctgcataggagatgactctgctgtgagactggatgtccacaatcatcttggggaccgtggtggaggtgaaaccgatgtcaggcaaggacaggttggagaggaagaagtacattggggtgtttggggtgagtataggctgatggccaggatgatgagcaggttcnncagcaccgtgaccaggcacatggacaggaaca

SEQ ID NO: 10725 - DNA, 640 bp, Homo sapiens
acaagtttgtacaaaaaacaggctggtaccggtccggaattcccgggatatcgtcgacccacgcgtccgggtgggatggatttggcccgtgggccatagtttgcctgcccctgatctcaacgttttcacaaatgtcaatctgaccatctgctttgtacagcacagagaggccaagcaacttgtctacagtaacacagctgcaaacctggccacactcaaaccagaagccaggcatctatattcccagtttgtttcgggaacaaaggagaaaagtttgaatcctccagttttttcactgaaagtggttccatgctgggtgacgtctttaaaagttactgttgttactggtaaaggcacagaggtttctccaggcttcccatcctggagaagggattggcaacgcataagacactctgctttagaagaaagatcaagtatgcactcgtcctctgactgttgttcaagtcaaacaaaccaggccagacagcgaacagtcagctttattcactcaagccctccttcactggagcacacattacttttctatacgatgacttgccaaatgcttaaaaggcacattttaaagaataacaaatgctactctgtttctttctggtggccaggacatcttgtgtttaca

SEQ ID NO: 10726 - DNA, 534 bp, Homo sapiens
tttgtacaaaaaagcaggctggtaccggtccggaattcccgggatatcgtcgacccacgcgtccgcccacgcgtccgcccacgcgtccgcccacgcgtccgcccacgcgtccggacaaacagagagccaaatcatgagtgaactcccattcacaattgcttcaaagagaataaaatacctaggaatccaacttacaagggatgtgaaggacctcttcaaggagaactacaaccactgctcagtgaaataaaagaggacacaaagaaatggaagaacattccatgctcctgggtaggaagaatcaatatcatgaaaatggccatgttgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagccagaggcatcacgctacctgacttcaaactatcctacaaggctacagtaaccaaaacagca

SEQ ID NO: 10727 - DNA, 667 bp, Homo sapiens
tgacactatagaacaagtttgtacaaaaaagcagctggtaccggtccggaattcccgggatatcgtcgacccacgcgtccgcccacgcgtccgcactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttgggttagtgacatttaaaatttttgtttggtttaacttaagtcttttaatatgtttaattttctaagatgttttctatttggttaaatctcactgcaaacatgaaaattagaaaatgaatgtaatgaaattttgcagtatacatttctcatgcatttttttctataattgtagttataaaagtattttctttcttattaaattgttaaagatattggaaatataagccaaaaatactttaaataagagtttaatttctcttgattgcatatgacaaacagtatttgtgaaactgtgtgtatacacacatatatataactgagtatatatgcttatacacatataagctcctttatctgtttattaaatatacgcatatatataagca

SEQ ID NO: 10728 - DNA, 604 bp, Homo sapiens
acgccaagctctaatacgactcactatagggaaagctggtacgcctgcaggtaccggtccggaattcccgggtcgactactactactaaattcgcggacgtgtcgaccagacggaaccatggaagccccagcgcagcttctcttcctcctgctactctggctcccagataccactggagaaatagtgatgacgcagtctccagtcaccctgtctgtgtctccaggggaaagagccaccctctcttgcagggccagtcagagtgttgacagcaacttagcctggtaccagcagaaacctggccaggctcccaggctcctcatctatggtgcatccaccagggccactggtgtcccagccaggttcagtggcagtgggtctgggacagagttcactctcaccatgagcagcttgcagactgaagattttgcagtttattcctgtcagcagtatagtttctggcctcgcccgtcgtggacgttcggccaagggaccaaggtggaaatcaaacgaactgtggctgcaccatctgtcttcatcctcccgccatctgatgagcagttgaaatctggaactgcctctgttgtgtgcctgctgaataacttc

SEQ ID NO: 10729 - DNA, 429 bp, Homo sapiens
  misc_feature 278, 406: n = A,T,C or G
atctaattagttttaaaatttattctctactcacaagaagcataaataaaggtttcactcttatataaagacctgacaatacatacaatggtcctctgctgatttggaagcaaagacagttttctacgacagtctgttctttataatgtataactgttgtgggaaaaaagaaaatccatttcttattgtaattatttttcttatttgaggtttcttttccacgatgacccaaccacaagtttgggaacattgcttctgaggcccattctctgatgagnaaagttcagtcccaactggggaaagtacctgagtcccagccttttcagcctaggaaatcagggctgagcgtgggtgggtgcgcgcctgtaatcctaggctactcgggagggctgaggcagggagaatngcttggaacccgggtggggagag

SEQ ID NO: 10730 - DNA, 91 bp, Homo sapiens
tatcacaaactcacatgaataaggctaggtggcaaacattcattcattactatctttgctaaaatgctgactataattgatctaccacact

SEQ ID NO: 10731 - DNA, 638 bp, Homo sapiens; identical to SEQ ID NO: 285
  misc_feature 545: n = A,T,C or G

SEQ ID NO: 10732 - DNA, 619 bp, Homo sapiens
tcggcacgaggaataaagaaagatttgggatttgcagaatcttctggcccaattaaaaacaaaagaagctgtaaatatccagaacttaatagatgtataaattataaacaaaacatgtccctgccccaaggtattgaaattacattactatagatacatcccatttatgaggtagtccgattcctcagatgtaatgggacgagcttttttcagtttctgtttcaccagtcgtagtcggcatgcaaccatgagaagcagcagagcagtgatagccaaacccagcgccaggggtagcactgcacctgtttctggggctgggtgttcccctcctcctccatcaccctttgactcaaatatataactttcctcttttctgttcttccctgaggaactactatctggcatcacaggaatgatttgactctctggtccccaaaaggcggaatgattcctcttctctgtgtttgataatgcaggtggcttgtttggggcagtggctttctgagacttttccaccaaggagtcaccccctgattgaggcaccttcatgtccactgacgggtccccctgcagcagtgcccactcatactggacgatggcgtggtcatctgtgctctcg

SEQ ID NO: 10733 - DNA, 559 bp, Homo sapiens
atctaagttccatcatagttccagatgtagttggtacaattgggatatcttcagcttctaagggtattgaccatggaatatgaaattgtggagcaagttctcgcattacaatatttccaagtatttttgcacagtcatcataatacttcatggaatttttcacaaaactgaagccattgacatcacagacataggactgtccattggcccgtaacaaatcaaagccacaaactgtttgcttaaaagcaaggcagactttccaagcaattaatttctctcgtgcattgagaataacagggtatcttacttcttttccttcactgtctcgttccaccttgccatcaagtgctggagattttcgagcttcagcatgggcataatctggacccactgtataaaccttaacatcagtaccatctgtgggcataaactcttcatatatatatgagcctgtttttcgtacattgctttctggagaataaacactacttctactgccaatctttctaaagagtctttgacttccaccaccagcagaagttgggtaataaatgtaaac

SEQ ID NO: 10734 - DNA, 699 bp, Homo sapiens
  misc_feature 583, 589, 595, 611, 613, 619, 643, 655, 658, 659, 660, 672,676, 678, 686, 695, 698: n = A,T,C or G
ctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaagtatgatgagaatgggcaagggtgtcagcatctcttcttcttaataataattgnttcagntttggntcacgaagatgctaantnatctgnatggtgccaagctggattatctgntttattatctanggnnnaagctgctatcntacngnaaaccacnctggagagntanc

SEQ ID NO: 10735 - DNA, 390 bp, Homo sapiens
aacgtcacaaggctgatgactagaagagttacaggcacttggacgtggatctgatgagttcatttaccttttactgagcgcattttatgtgctaagtattcagaaatagatgttatactgctgtggagtcagacatataaatagatgtttatactacagcatgataaacagtataatagagatggactcgaaatattctgtttaaaaaacgcttagcaggagtatagattccagttgccctgaatatacactccctttttaaaaaaaaattattttttgaaatattctaggatgagtagagagatgagagtggaaagactcccggcttacatgtcagacagaactggctggctttgctatattcatattaaatatttttgttttggacat

SEQ ID NO: 10736 - DNA, 614 bp, Homo sapiens
  misc_feature 559, 580: n = A,T,C or G
ggggtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaatggtcccaacaaacaaaaggngaagcttttaataagaattgnttataatgatctgtttagaatttataatctcagt

SEQ ID NO: 10737 - DNA, 639 bp, Homo sapiens
  misc_feature 473, 555, 577, 603, 608, 609, 623, 634: n = A,T,C or G
attgggaggcttaggtatttttgttgttgtttgtttgttttgagatagagacttactctgttgcccaggctggagtgcagtggtgcaatctcagctcactgtaccgtccacctcccgggttcaagcgattctcctgcttcagcctccagagtagctgggattacaggtgcctgccaccatgctgggctgatttttttataattttaataggggtggggtttcacagtgttggccaggctggtcgcaaactcctgacctcaagtgatccacgtgcctcggcctcccaaagtgctgggattacaggtgtgagccaacatgcctggccagaaggttctggtttgttaaccaggtaaggtctgcacatttaaaactgagaaatgctagcttcctagcaagcagaatggaatatatagaattgactgcatggtctcctttacttcctatcggaaaagtctttttactctgctgactanagtgtatgtgtgtgtgtgtgtgtgtgtgtgtgtgtgtgtgtatttcttttgcttcaattcattaaaaaaaaaataaaatganctgggtttggaggctgaggcangaggattgcttgacccctatgatttnaatcnncctgtgcaatacancaagatctatntttgg

SEQ ID NO: 10738 - DNA, 756 bp, Homo sapiens
  misc_feature 1, 8, 630, 715, 716, 730, 754: n = A,T,C or G
nagacagnagggatttacttcacccatgagcattgaagactattccttaaatctgtaagctgctgatctatttatagaagctctttccactggcctctacttccttcctcccagtctttcctgcgtacaaagctcaccactgcacacaataactcttcctaaagggacaagcagtatcgttgggcctgcagttgccttagagccagatgagccaacagctgagagctttagacactgatgtctgagggacaactagtcactggccatatttggtgctgtttccctgcctcagtggccttaggctgtggggtttccatatggtattgacctctgcagtgaagtactcagctatgtctggtcccatagatgtgactatgtgaacactatgcctcagtagatggaggctgttctttgactcgttctgcaactgcattgccagacccagagggccatggtagggggagtattgtttggggactaggaaattcttgctgtcaacatttgaaagttctaaagtcactttgaagctgtaaaccaaaaataaaattctaagccctccaaccaattgaatggacccccttgttggccaagggcattccaaagtaaacctgaaaaacgagttcaagccangataggaagtggaggttggcagtccccctttatgtcctcttccttttggaatcaggcatactgaccacattaacattaaacaganncttggcagggcagngctacacctatatcctagcacttnag

SEQ ID NO: 10739 - DNA, 96 bp, Homo sapiens
aaactaacccctctttttctccaaaggagtgcttgtggagatcggatcttttctccagcaattgggggaaagaaggctttttctctgaattcgctt

SEQ ID NO: 10740 - DNA, 742 bp, Homo sapiens
  misc_feature 1, 8, 632, 671, 709: n = A,T,C or G
nagacagnagggggtcttcattcaatgtgtgatcaatgctgtgtttgccaagatctggtggatcgtacccggagctggctctatgctgcctgttctatctcctatctgggtaccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacgggtgtgtattttggtcccctgacctgctncatcatcactacaactcgaaagttcttcacgattttggnctctgtgatcctcttcgccatccctcaccccatgcagngggtgggcactgggcttgggtcctgggccttgg

SEQ ID NO: 10741 - DNA, 545 bp, Homo sapiens
cctatcattctttgaccacttccttccttccttagtacaaaatattccaagctcatcttgtactttgccttctcagtcctagaataagtcatttctccaatgaggctggttatttttagtggggaatggtatttaaaaatcaagatcttggcactagttttgctcgttgctacaggagggctcttgcttcttggctctttggatggaactagggaacacactatgttcttcatactggtatcaccaattaacaccctcatcacaaggttttcctggtctcctttcatatattctctctctctctatgtatatatatgtgtgtgtgtgtgtgtgtatgtatgtgtttgtgtattatgcacatatatatacacatatatacacacatgtgtatatacacacgcatatacatgtatatcttccagtgagaacctctgttcccaagaacatcaaattatttattcatttgctgtgtcctgtaatgtacacaaacaaattttaagattaatatacccagtgctattatcaacaataagacaacagtcttt

SEQ ID NO: 10742 - DNA, 313 bp, Homo sapiens
ggggatgtgccacccgccttttgcctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 10743 - DNA, 534 bp, Homo sapiens
cggcacgagggctcccaaccgtcaccaacgtttaccgctgtcatggaggtgaggtggaggaggctgcagggccacccagcatcctgggatgcaggctctccaaggtcccagcagaaccccacactggtggtcctactgcccacccagagccgaactcgacaggggaccgatttgaaagtaaaccaacattcttaatgtcaacacaatgtttgtttaaaaaaaaaatcaaaatgtgcaaagtggcagtgactgtccagttttgaaaagcgtctaacaagtccgagcgtgttcaattttctttaacaactgctgctgtcttgcctgcaatttttccttttccagcaaaagctggtgctcctcggcctggagggagtggacatactcagtggcctttttcaaaatgaccaccttggcggccttctcattctttaccaactccggcacgtggtccctgagcgtgaaaaacctggaccgaaggtcgttgcggcgctggcgctccaggatgttgtggtttctgcgacgctcactgtcctc

SEQ ID NO: 10744 - DNA, 322 bp, Homo sapiens
tccaccgcggtggcggccgctctagaactagtggatcccccgggctgcaggaattcggcacgaggttatcctagcgctttgggaggccgaggtgggcagatcacttgagatcaggagttcgagatcagcctggccaacatgatgaaatccactctgtactaaaaatacaaaaattagccgagcacagaggcaggcgcctgtaatccgagctacttggaggctgaggcaggagaattacttgaacctggaaggaagaggttgcagtgagccgagatcatgccactgcattccagcctgggacacaagaatgagactctgactc

SEQ ID NO: 10745 - DNA, 551 bp, Homo sapiens
aacaatttactttttataaaaagacaaatgtacatatttacacacgtcctatgtgttcacacatgacttaatggttagatgacatttccaattttaagtcataccaaggcgctcacacttccctccctgggcctgttgagggctgctggggcttgagggggtggtgggcgccgagcaaggcactgtataaataaatgcaaaggccaagagctcgggggaaatgttagtgtacacctctgatcagaaatgtggcaagatccacacgaaaaagtgccaagtttttttcccaagcccctcagccaaagcagggagcagggtagagctcctctgaggctgagggagcatcgccccgaaggaccccactttccttcacatttcactggctttggaacagtccccagggctcagctgaaaagggggtagttctttgggaacgagattcatttagtgcaattttctcttagtgcagagccagccctgggattggtgttatgcttttctggggtcactggtctgttcccctaggagccagccagtgacagcgagaccct

SEQ ID NO: 10746 - DNA, 485 bp, Homo sapiens
agcttgcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaa

SEQ ID NO: 10747 - DNA, 692 bp, Homo sapiens
  misc_feature 535, 647: n = A,T,C or G
atttttaaaactttattttaaaaatatgagcatctattttaaaagttttgataattattgccattattttcttgtgattggtacaatttaaaaataagtctatgttttcacattgattttaaaaaatatagcatgtttgaattacaaatgattaagcaaactctattacttcatagctgaccatcttccagaaaattcccacttaattgaatacttagaaaaaaatggccagtggccgattgaaaggtatattaaaattaagggcagttttaattctgaagacaaatatcttcatggaaatctatttgtaagcttctgagattgctgctgaaagtctacagtctgtgaatataccaattcccctttacaactgatgcagatcattatgaaatactggaaggcataccctacaatttaggaattggtgtggctgccactgctatgctctcaattgcacactcatcagttcctctgcggatccggaagtagccattctcaccccagccggtgccccagctggttttaacaatccagntatccatcccagaagctgagtcagtgccatagcccacaagcagaacagcatgattagtcagctccaaagggttgaaggggtctcttagaccagtgtggtcgagatcccctcnttgagtggaggagtcatcatatacttcaaaagcaactgccatggg

SEQ ID NO: 10748 - DNA, 549 bp, Homo sapiens
ctatttaggtgacactataggaacagtttgtacaaaaaacaggctggtaccggtccggaattcccgggatatcgtcgacccacgcgtccgcccacgcgtccgcagaactcaaagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcag

SEQ ID NO: 10749 - DNA, 464 bp, Homo sapiens
ccagtagttccaaggcccgggaagcctggagggccacttatgcctggaaaacccttaggccctggttcacccttggatcctttcttccctttggggaatcccatgaattccagctctccagtagatggtggaggtcctgctgggccagggaggccaacatcccccttgactcctttctctccttgaaaacctagccccatattcccatcaggaccaagaggaccaggaggccctggaggaccttgtaatcctggtggtcctgcaggtcctacagctccaggaaatccgggtgctccttgtgggccagtgattccatccagtccaggcagcccaggatcccccttcattcctttgaaactacctggagcaaggacagggtcaccttttgatcctttctgaccaggaagcccgggtggtccgagaagcccaggatagccatcagggcctggaaatccaacagctcc

SEQ ID NO: 10750 - DNA, 785 bp, Homo sapiens
  misc_feature 617, 634, 669, 726, 736, 758, 764: n = A,T,C or G
tgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgccttatactctacactcattcttaacttttcgcaaacgtttcacacggactaatctttctgaactgtaatatttaaagaaaaaaaaagtagttttgtatcaacctaaatgagtccaagttcaaaaatattcatttcaatcttttcataattgttgacctangatataatacatttgcnagtggcatgtacatactgttataggccgattaacngttataaagtttgtacctttattttatggcattttaccatgtaagttttgaactaangttggtaggngaagtttcttatggaccgatancccgcncacatttaaccatcttgggcc

SEQ ID NO: 10751 - DNA, 411 bp, Homo sapiens
ttcggcacgaggcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggactggcacgacaggcccac

SEQ ID NO: 10752 - DNA, 425 bp, Homo sapiens
  misc_feature 267: n = A,T,C or G
ggcggctcggactgagcaggactttccttatcccagttgattgtgcagaatacactgcctgtcgcttgtcttctattcaccatggcttcttctgatatccaggtgaaagaactggagaagcgtgcctcaggcaggcttttgagctgattctcagccctcggtcaaaagaatctgttccagaattccccctttcccctccaaagaagaaggatctttccctggaggaaattcagaagaaattagaagctgcagaagaaagacgcaagncccatgaagctgaggtcttgaagcagctggctgagaaacgagagcaccgagaaagaagtgcttcagaaggcaatagaagagaacaacaacttcagtaaaatggcagaagagaaactgacccacaaaatggaagctaataaagagaaccgagaggcaca

SEQ ID NO: 10753 - DNA, 414 bp, Homo sapiens
tatgacgtcgcatgcacgcgtacgtaagcttggatcctctagagcggccgcctactactactaaattcgcggccgcgtcgaccgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcgtcgacgcggccgcgaatttagtag

SEQ ID NO: 10754 - DNA, 459 bp, Homo sapiens
  misc_feature 304, 388, 456: n = A,T,C or G
ccgaaaccactcgccctccactgactgcccctgtaccacatcaaacagtctcctctcctccacgcctccggggtctgggaagtctcacctcactgatttcacgtagaaaagaaggcggaggccagcagccgccgccgccagctccccaacgtgcaaatccatttcagtttgaccgtgaacccccttccagttcgtgtcctcctccgcccccgcccctagctcccgctgctgcgcttccaacggggttctcgggtcatttcctagcgccggtcacactggctggcctcctcccctcaacatctcntcctccggctgcagagggggcaaggggaaaagagggaggaaaaaaaagccccaaacgggaattcgccttgcgttggagtctctnagtcccggcgttcccccaaaacatctgccatcggccaaattcgtcaacccggaagccttcttgtcttnaat

SEQ ID NO: 10755 - DNA, 845 bp, Homo sapiens
  misc_feature 12, 15, 17, 20, 31, 42, 44, 60, 63, 70, 72, 76, 608, 702,769, 782, 791, 804, 816, 818, 835: n = A,T,C or G
tcttttgacctncgnanaancttgcttgttncttttggccgnancggcctaggctgcganagnagacagnangggnaagatgaatgttctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcangttgttggtgctggggctcatcgagctctcctggaacacatacccttccacatcctgcagctctgctgccctgcacatatgccatgccgtcatnctgctgcagctctggctgggccgcacctttccccagagcacccacacagcaagaaagccactgaagncacccctttcctnagacctgantctacctcagacnggggtgggtggntntgccttcaaaaaacttntaatacaaaa

SEQ ID NO: 10756 - DNA, 849 bp, Homo sapiens
  misc_feature 9, 10, 14, 17, 18, 20, 30, 62, 505, 626, 789, 843: n = A,T,C or G
atcttcccnncgcnaanncntgcttgttcntttggccgagcggcctaggctgcgagtaagangacagaagggtctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctcttgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattangaaaaaaaaataaacctcctgatcggagacaatgtattaatcagaagtgtaaactgccagttctatatagcatgaaatgaaaagacagctaatttggtccaacaaacatgactgggtctanggcacccaggctgattcagctgatttcctaccagcctttgcctcttcttcaatgggggttcatgggaatttgcttcaaaaagccagtttggctgtcaaagggccacctgcttttcttactctttaaagggctaaaaacttgtacggccagaaaattgtgcaanctctggaagatcaaataggggctttttgcaccctggggtatgggggacttcttnaattcc

SEQ ID NO: 10757 - DNA, 207 bp, Homo sapiens
agtgtatacagaaacgaatagatgtgtaactgtatgcagactggttgcattgaaacaaatctgataactatgcaggtttaaattttcttatctgattatggtaagtattccttagataggttcttctttgaaaacctgatgattgacaggttgatgaatggaaattatttcacttcattatatgcaagttttcaataattacgtcta

SEQ ID NO: 10758 - DNA, 782 bp, Homo sapiens
  misc_feature 5, 7, 593, 656, 765, 773: n = A,T,C or G
acagnanggggaggtgctgtctcaccggtgaggcctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcgggccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctncagaaacgcttcatcctgaatctgccaaccttcagtgttcgaatcattgacaaaaatggcatncatgacctggataacatttcctttcccaacagggctcctaacatcatgtcctccttccacttgcaggaactttttttgatggctccttattttttctactctttcagcncctctganaatggtaat

SEQ ID NO: 10759 - DNA, 737 bp, Homo sapiens
  misc_feature 482, 623, 644, 651, 674, 693, 696, 698, 710, 723: n = A,T,C or G
cagggagcttatggtattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtangctgaggtgggagtattgcttgaggctgcagtgaggtgtgatcacgccactgcactccggcctgacagaatgagatcctgtctcaaaaagaaaattccccagaagaagattctaattttttcaagctgaattaagtttganagtcttttttaaatcttatgngtcaaanagcatatgttgctgggtgattangaaaagggccctccatttntgncncctggaaggccnatgggcttacatncccccccccccccc

SEQ ID NO: 10760 - DNA, 74 bp, Homo sapiens
tccaccgcggtggcggccgctctagaactagtggatcccccgggctgcaggaattcggcacgagggatcacttg

SEQ ID NO: 10761 - DNA, 63 bp, Homo sapiens; identical to SEQ ID NO: 10673

SEQ ID NO: 10762 - DNA, 637 bp, Homo sapiens
attcggcacgagggcgagggtagcccggggccgcttggagttgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagatggcccagcacagccgggtgcactctggggaacgcccgtttcagtgtccacactgccctcgccgctttat

SEQ ID NO: 10763 - DNA, 601 bp, Homo sapiens
tgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatc

SEQ ID NO: 10764 - DNA, 624 bp, Homo sapiens
tcggcacgagggctgccgctgggaccccgtgtcatcgcccaggccgagcacgatgccccctaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcc

SEQ ID NO: 10765 - DNA, 422 bp, Homo sapiens
  misc_feature 78: n = A,T,C or G
ctgttcccattatgctggtaggaaacaaggctgacattcgtgacactgctgctacagagggacaaaaatgtgtcccanggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaaccc

SEQ ID NO: 10766 - DNA, 597 bp, Homo sapiens
tcggcacgagccatcgtgtccccttgtcacccccactccgcagggagttgaagcagcgctccatgaaggctcccagcgagccgcgcttccggctgcatgattacgttaagagggagggtcgaggggcctcctgctgccgcccttgaacctggctgagctcagtcctctggaggaagccgcccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtc

SEQ ID NO: 10767 - DNA, 496 bp, Homo sapiens
  misc_feature 179: n = A,T,C or G
ttgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgctgcgaaccctccaccanctaccggagggaggagggaggatgcgctgtggggttgtttttgccataagcgaactttgtgcctgtcctaaaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttga

SEQ ID NO: 10768 - DNA, 632 bp, Homo sapiens
  misc_feature 43: n = A,T,C or G
cggcacgagggtactgggtatgtgtcacattgccaaatcccgngacacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcact

SEQ ID NO: 10769 - DNA, 580 bp, Homo sapiens
ttcggcacgaggcgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctg

SEQ ID NO: 10770 - DNA, 564 bp, Homo sapiens
tcggcacgagggcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgt

SEQ ID NO: 10771 - DNA, 581 bp, Homo sapiens
caagctacttgttctttttgcaggatcccatcgattcgaattcggcacgaggcgcgagcgtcggctccgcctgggcccttgcggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatg

SEQ ID NO: 10772 - DNA, 439 bp, Homo sapiens
gggggacatctgtatttatttgaggcaccaaagcagcaggagggctccaatgtgggggtgggctggggcaggactggctggatttggggcagggctagacccggaagtggcagaaaccccaacccccaaaggctgcccttgaagtgcatgcagctgtgccagggcagggggctacagggactgaggctctccaggctgctggcacacctccctccccaaacatggcccccagaagccgccacgtgctctcacgtgcactgcacacccacgtacacagccaggcacacatccctactgacacggtctccctggggaccctgtcagcatgtccatgggacttggtcctgatgttggaccgtaagactccagggaaccctcgtcccttccgcagtcccccaaggaaggtcacatcatccaccccagaagtgagggcagctgg

SEQ ID NO: 10773 - DNA, 495 bp, Homo sapiens
gctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccggcggtgacgtggatatcggcgatgc

SEQ ID NO: 10774 - DNA, 231 bp, Homo sapiens
taccggtccggaattcccgggtcgacccacgcgtccgctttgttctgttatacaaaatcattcattatgatcagaaagattgatgataccaccatgaaaaataggatgtttaccccaaaacaagtgtgaattaagaatttgaacacaaccacattttttaaaatgaaacttctatgcggaagtaaattaatttggagcaataaagtaccagtatttaataaaatgtacaat

SEQ ID NO: 10775 - DNA, 250 bp, Homo sapiens
ctggagggatgtatcttgagggatggatagcatttgatttttctaagtcttggagaagagcattctgggggccttatttcacctctctgtgcctcagttttctcatctgggcgtggtggcgcgcgcctgtagtcccagctactcgaggtgctggggcaggataatcgcttgaacccgggaggcggaggttgcagtgaggagagatcgcgccattgcattccagcctggcgatatagccagactccgtctc

SEQ ID NO: 10776 - DNA, 420 bp, Homo sapiens
gctccaccgcggtggcggccgctctagaactagtggatcccccgggctgcaggaattcggcacgagtcgaaattagccacactttaaaagtaaaaagaaataggtgaaaataattttaatatgctttaacacaatatatctcaaatataatttcaacatgcaatcaatattttaaacatttagtgagatattttacattttttcacactaagccttggaatctagtgtgtattttgcacttacagcatttctcaattcagccactaaattttcatcaaaaatgctcaataagtatttagatttcaaaaagtttacagttgaaaaggtagagtcacatacccaagttgctccaattatacctacaaatttttaaataactaagtttagtatcaatttttaaatttacattaattaaatggc

SEQ ID NO: 10777 - DNA, 487 bp, Homo sapiens
  misc_feature 145: n = A,T,C or G
tctaatacgactcactataggggaaagctggtacgcctgcaggtaccggtccggaattcccgggtcgacccacgcgtccgggccggacggcgcgggcgccggcgaggagagcccgcggctgcagggctgtgactccctgacgcanatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctac

SEQ ID NO: 10778 - DNA, 426 bp, Homo sapiens
ttggagaacaggtgtgtgtcattcacgatgggcttcatcacagcgtctaccacagcgtattttgctacactgacagcattaccatcacttatgtgtactgatttatatgccaaagaaagtatcactggggtgtggtgtgtaccttgccttatatcaccaacatgtaactttgatatttcttcttcataacaaaaaagaaaaattatttaatttctctaatttttgttacaaagcaaagtaacatcctacaaagcaggttttgatcatttctggcagcaatcagttttcttctctactttaattcaagagtaaattttgttttcgaatgaatgaataagtgaattgtagctggtactatgatccacccacctgtacttctttttgactctgatagtgaatagaagtttacaaaagtttaccctccta

SEQ ID NO: 10779 - DNA, 462 bp, Homo sapiens
  misc_feature 334, 344, 377, 395, 431: n = A,T,C or G
aatataaaaagatcaatgaaaaatttatttataaatttttcacgctgggctacaggtcaatatcgtacactcaggaatgtgctgcacaaactttatccagttagcagtgatcaccccgtgacccacacacagcttcgctataagcctagaaagtcttaacattaattaacataattaaaaaggtatttgcatctaggaaaaaatatacagaagaactccttgtggagtaatctgtgcctccatttcaatgtctgcttgtttcactgacattatcaatatattcttctcacacaaagttttataaaaaggcgacgggggggctgcccgaatacgnccagccacgnacaaggggcctccacccacctgtgtcctcaagnggttcccctttttggcangaggggttagcaggcatttcctggagggggggaacncctttgaatttggatatttaggctccctttt

SEQ ID NO: 10780 - DNA, 628 bp, Homo sapiens
  misc_feature 625: n = A,T,C or G
tttctgcctctgctttcatttctatggttattcgtggaatgactctttgaccacgcggagaaggcaaaacttcagccatttgtgtttttttccccttggccttcccccctttcccaggaagtccgacttgttcatcttgtttttccttggcttcaacagcctccaattcttcaataaatgtagccaagtcttctttccacaaatctgatggactctttctttttaatgtgtccagctcttgttctttttcatttcttagcctgcagagttcatctttcttttccttggttaaataccaaaggggcatatcaagaagatagttgaaggttggtccagaatctgttacggagtcactcttttcagtttccttttcgttgtcactctcttcattttcttcttcatctggaaccttttgctgggcttctttccaggccttcacaggatccgaatcatatcccctctgaatcagaactttaattaattctttcttaggcttattttcaatgattattttgccatctattttctctaagataaagcgagcctgattattagtttagcagattcagcaccaagcattcctaagagccattcttttcttaatccataatatttaagtctgagnttc

SEQ ID NO: 10781 - DNA, 465 bp, Homo sapiens
  misc_feature 357: n = A,T,C or G
gcagcagctgcatgatgagggtgctgtctttgtaggagtcctcgctgagggtgtgcagatcagccatggcctcgtcgaaagtggtcttggccagagagatggcctcctcggggctgttggcgatctcgtagtggaagacggaaaagttcagggccaggcccaggcggatggggttggtgggcggcatctccttcttgctgatgtccatggcctcctggtaggctgaccgggctgagtcaatgatgcgcttcttgtcgtcaccggtggccacctcggccaggtagcggtagtagtcacccttcatcttcaggtagaagacccggctctcggcgtccccggcctccttgatgaggtggnctgtccagcaggcccagcacggagtcgcacacgccctggagctcagtctccaccttctccccgtactcacgcacctcgggccccttctccttcgagcccttctcgttg

SEQ ID NO: 10782 - DNA, 299 bp, Homo sapiens
aaccgcatgagacacacacgaaagacggccctgccttccagggctcgctagatccttggttcctgtcgtggaagagaggggcagagtcttgctctgtcacccaggatggagtgcagcggcgtgatctcagctcattgcaacctccacctcctgggtgcaagcgattctcctgcctcagcttcccaagtagctgggattacaggcgtgcaccactacatccagagactgggactacaggcatggattttcaggtttataacatggcagagtgaattctggcaacacactgagtgatgctt

SEQ ID NO: 10783 - DNA, 629 bp, Homo sapiens
acagaaggggaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacgcacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagagcttgtgggaaatgattttaaaagtattgatagaaggacttcaactcccaattcacgtattcagagagccactacggtttcacaaaaaaagtcttcaaagctttgtacttgtacagaacccatcaggaaagtcccagtttctaagacccctaagaaaactcattcagatgccaaaaaaagacagaatagaagttcaaattacctaagttgtagaacaactccagctatagtgccgccaaagaaatttcgtcagtgtcctgagccaacttcaacagctgagaaacttggcctgaa

SEQ ID NO: 10784 - DNA, 641 bp, Homo sapiens
caataaatgttagctttccccttataatgacatttgtccttttcttctttgccatgggttttgattttttcccctattattgtctctttgggggttttatttttaagagattgcatgccaccagaatctgaacaacaataacaaaaacctagtaccttctggaagtagaatttactcttttgccgttggcaggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggggcgagaccgattcaaatcacatccttccttgtctaccaccaaccaacagatgtcacccatcattcagtcaggctccagcaaaccttcaccaatttacatcagttcctattcctcaccagca

SEQ ID NO: 10785 - DNA, 666 bp, Homo sapiens
catctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcaga

SEQ ID NO: 10786 - DNA, 57 bp, Homo sapiens
agctacttgttctttttgcaggatcccatcgataagcttgcttgttcttttggccga

SEQ ID NO: 10787 - DNA, 551 bp, Homo sapiens
  misc_feature 97: n = A,T,C or G
acagaagggattttccttttcaaataggtctaactcagcaactcgctttaggtcagcagcctccctgaagaccaaaattagaatatccatgacctanttttccatgcgtgtttctgactctgagctacagagtctggtgaagctcacttctgggcttcatctggcaacatctttatccgcagtgggtatggttgacactagcccaatgaaatgaattaaagtggaccaatagggctgagctctctgtgggctggcagtcccggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccatctgttatgctgtgacacatggcccctccccctg

SEQ ID NO: 10788 - DNA, 513 bp, Homo sapiens
  misc_feature 345, 346, 347, 348, 349, 350, 351, 352, 353, 354, 355: n = A,T,C or G
tgttacctgccgacagcataaagcgaggcaaggtccagccgttccgcccggcatacaagcttatggagcagccccctttgaagatctccaggtggacttcacagagatgtcaaagtgtagagttcaccctttctccccaggtgatcgagtgtggatcaagaactggaacgtagcctccttgtgtccactgtggaaaggaccccagactgtcgttctgagcactcccaccgctgtgaaggtagaaggaatcccagcctggatccaccacagccatgtaaaacctgcagcgcctgaaacctgggaggcaagaccaagcccagacaacccctgcagagtgaccctgannnnnnnnnnnagccctgctccagtcacacccggaagctgactggtccacgcacggccgaagcctgaggaagctcatcatgagattcatttttcttaaattttggacttatacagtaagggcttcaactgatcttactcaaactggggactgttcccagtgtactcatc

SEQ ID NO: 10789 - DNA, 173 bp, Homo sapiens
  misc_feature 24, 41: n = A,T,C or G
agtggctcacccttgtaatcctancactttatgaggctgangcgggtggatcacctgaggttgggagttcgagaccagcctgaccgacatggagaaaccccatctctactaaaaatactaaaaattagccaggtgtggtggctacatgccaaggattacatgcctgtaatccc

SEQ ID NO: 10790 - DNA, 458 bp, Homo sapiens
ttcgaatgaattaaaagtttaattctgaaccattttttataaccgcattttctcttgaagcatcgtatcacagcaggttacaacaactttgggataaaaggcaactggtaaactgtccaaaacaaggttccaaataacacctcttactgatttaccctacccatacatatcccaaatagtttttgatcaaaaacatgaaatagatccacctgcttattttaagcatattaaaaaggaaactaattggaccattttctatttgtctattttatacaaaaaggctacacaattgttacactttattcagattacaattaattagagtgattatgaattaattagtgttctacaccattactcaattcttaaaaattagaaattgctgtagcagtattcactataacttaacactacgagagacttaaaaaacagttactgcaaaaaaaaaagagctactt

SEQ ID NO: 10791 - DNA, 863 bp, Homo sapiens
  misc_feature 503, 580, 749: n = A,T,C or G
aacaatgactctttataaacttgtatggggtctaaattatcccttgtaatatatatgtgtgtattcattccacagagaattagatgatccgcctccaggtaacctgctgggaatttcttgagattttggctccccttgaatggccgcatccaacttgttttgttagaactcccagcatcacagcgatggcagctctcttagattccccatacatccacgacctatatcatgtccaataaatcgtccacatcaccaccttcttcaaatacagctgctgtgtctccacttggtttgtctttgggggccagaaactttttggcttcctcagctgtgacagaacttccagaggcttcctctttggtgatcagagtaattccatcctggacaacaatttcccagaaatgatttaattgtttaatttccactttctcttgaagggctttcaggaagttgttaaagcgctgctcttctgaaaacttaatggcttcttccccgaaggctcngatgcagtctatgctcttcataaaatacggtgtttcattagtatccaaaaactgttcgatgtgatttatgagctggntactcgcttcctcaaagctggcctttcttctgtttactagaacacggaaagtttcagcaggattcacactttccacagaggtgacactgccttcagccagactggagaacctgaagtgggcccccccttgtcagtctttaatttttagcttggagtccatcttcatggntggcttggaaaaattccctgacagccacttgatcctttttttggcttcaatcaaagaaaaaggtctttattttaaagagaggatttgacttttcgttgcacctaacgggaggat

SEQ ID NO: 10792 - DNA, 377 bp, Homo sapiens
ccccgggctgcaggaattcggcacgaggataccgctgaccttcatttgtggaatcctcagtcatcgacacacaagacaggtgactaggcagggacacagatcaaacactatttccgggtcctcgtggtgggattggtctctctctctctctctctctctctctctctctctcgcacgcgcacgcgcgcacacacacacacaatttatatatctagttcacagagcacactcacttccccttttcacagtacgcaggctgagaaaaacccgccccaccctccacccggtggctgacgaaaccccttctctacaattgatgaaaaagatgatgtgggccgggcacgctatctcacgcctgtcactccggcactttggga

SEQ ID NO: 10793 - DNA, 541 bp, Homo sapiens
tccaccgcggtggcggccgctctagactagtggatcccccgggctgcaggaattcggcacgagcatgataaggacgctgctgctgtccactttggtggctggagccctcacttgtggggaccccacttacccaccttatgtgactagggtggttggcggtgaagaagcgaggcccaacatctggccctggcaggtctccctgcactacagctccaatggcaagtggtaccacacctgctgatggtccctgatagccaacagctgggtcctgacggctgcccactgaatcagctcctccaggacctaccgcgtggggctgggccggcacaacctctacgttgcggagtccggctcgctggcagtcagtgtctctaaaattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggc

SEQ ID NO: 10794 - DNA, 501 bp, Homo sapiens
cggcacgaggctgatgttggagcggcttcactttgtctattgcgaataagtttcttaaattcttcaaagagaagactggaatcttttaatacaggtacatgttattgtagctgtggtaatgctggctgcatctcaaacagggttaacttcagctcctgtggcaaattagcaacaaattctgacatcatatttatggtttctgtatctttgttgatgaaggatggcacaatttggaaagggcaccaaggaactctcgggtgaagcagcttcctgttctcagtgctttccctccgtccggtgagattcccagtgagactgtttgaataaaatcacctgccactggtctaggtgtctgaggagcatcttcctggctcaaagaccttttgctccaggtgctcatgccgcaaatggcaatctgcgcgcgaactaattcgcggccgcaagcttattccctttagtgagggttaattttagcttggcactggccgtcgtttacaacgt

SEQ ID NO: 10795 - DNA, 643 bp, Homo sapiens
attcggcacgatgacgacctccagtctgtagacacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtact

SEQ ID NO: 10796 - DNA, 625 bp, Homo sapiens
attcggcacgaggttttttttgggaaaaacaataataactttagtataagcctctcagctgacaatgacccaaggactgttcagcggcccaggcacctgaggagcaatgacagtctacgaggacatcttctgcagcaacagccatcaggagaccagcagcagcacagcactcagggctcggtgtccacctccctgcagatcactttctccctcactggaatcaaccgcagcacttggagtctactcatggagtagaaacttctttatggggtctggcagaggcagcgaaggaatcatatgaagccggtgtttgccaagagctcttctcacagccacacggcacagacacagcaaggttctgggaacacttctggcctctttaaagacctgcaaggcctcagggtccacttttcttcttcctctcgactctgggcccagcgattcccacttcactagattcaggttggctccaaattctaccagcaggctcacgaaggctgcctcacagccgtggcgcagaacagcatccatgacgcacccaggggagcccctgtagaatccctgtgtgttgacaggaccattgcagttgaagtcagggttcgcgccagccaggaggagcagccgg

SEQ ID NO: 10797 - DNA, 739 bp, Homo sapiens
  misc_feature 586, 587, 693: n = A,T,C or G
gagaagcaccaggtttaatattaaaatctttcccttaaaaaaaagtacacagatagaaaaacttaacagcatacaaaatagcatttctgctgtataaatgtgagttaacgtgagtcctaaaaatatttgtaaacctaggtgattatatctttggtaccgtattgagaacccactctccctccttggaccaactctggggatcccagggaagtaaggtgccaacctgcaatgcagggttggtgcccagaggggttgagcttcctgcacccccttcccaaccctccccgtgcgggggcgtcttggctacaaccctgactcccctggcacctccaatgcccactgggctggggacaatgagatgtcactgctaggtctgggcagtgacaaaaccatacccccatggagcgctgcctcagggatggggcagctggtgggtgaggggcaaacctccaaagcgcccacctctcacatccttcttgggtacccatctgaagcttcttgtcttttacaagacataactgtcctcactgtccattctgtcttcgacgcagacctcggcacagggtgctggagtgtggggctgcanngaggatctcatttgccctctttgtcccttttgcccaggatacccccccgaggtcatccgtgggtagtgaaagaggtccccgtgtcttccatgtcccttgggcagcntgctggggcttccaggacacccgctggcactctaagcaaaggcctg

SEQ ID NO: 10798 - DNA, 75 bp, Homo sapiens
ctatttaggtgacactatagaacaagtttgtacaaaaaagcggctggtaccggtccggaattcccgggatggccg

SEQ ID NO: 10799 - DNA, 327 bp, Homo sapiens
tcactcgagtgaacgcaaaggctgctttgcaaatcactgccctatggagggtgattaactgctagccaattacgcaacacttttaatcaattgtgcttaaggctctacatcaaatctggtgggtgcccttcttagagcagcgtcgactgacgaacgagcattcgctgaatgatgtcactgcagctcgtcaccacaccgtccatatactcagtcgccacagcgcacgcgaaatgagcggagcagaagcgactctcatctcctatgcctgcgctgattactacaaactcatctcgaatgacgtacttggactgactcacgcatcggtcc

SEQ ID NO: 10800 - DNA, 573 bp, Homo sapiens
  misc_feature 451: n = A,T,C or G
ggcctatttaggtgacactataggaacaagtttgtacaaaaaagcagctggtaccggtccggaattcccgggatatcgtcgacccacgcgtccgggtttgctgtgtgggggaagggaggaggtatgtaaaaataaaatggccatcctaagcaaagaagaatatacaaaatgatcttagggagataaccacaaatacgggggggggaaggaatcttaggatactttgctcatctctatcagataaatttggaaacttggagaaaatgggtaattctcaatgaaagtataacttactaaaacatactccagaggaaatagaaaatgtaaaccaatagaggaagttgttaagggagaaaaataatgttacagcatacttctatttttgtgtgtccacgtgtttttaaaggagggcaggggggaaaaagcatagagccagccaactatggcctancaaaacagtcacatttcaacctctgttgataaaagttataatattctgaatcttacactgcttattgccattgtcacaccccaccactatggggtatttgagtttcatttatctactataaa

SEQ ID NO: 10801 - DNA, 313 bp, Homo sapiens
gaagtacagttggcttcacaactaactattgctgccattgaaaaaaataggtggtgttgccactacagccttctatgatccaataattctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtact

SEQ ID NO: 10802 - DNA, 108 bp, Homo sapiens
tcaaaaagctccagcccagaaagcacctgctccaaaggcatctggcaagaaagcataagtggcaatcataaaaagtaataaaggttctttttgacctgttgaataaag

SEQ ID NO: 10803 - DNA, 639 bp, Homo sapiens
tgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcatta

SEQ ID NO: 10804 - DNA, 641 bp, Homo sapiens
taaaacaaaccatctttaataccaatatagttctctcttaaataccgtgtttcccaggacaaatgcaggggcaggctcttggcagaaagagtagaaaggaaatgtggaacaaaatggaatggatggcccaggcccagggtccctgccttgggcactagggactgggctgcctcggggatgggggagtgacagcagctccccctggtccagttattgcagaggcgtcgggggctcccctccctccccaggccttgaaacatttctcaggattacttctgaccttcagccccagcagggccagggcctgggctcctctggtctaggatgggcccctttgcccaaaagggcctgcagctaaggcgtggggtggggcggggagcccctggacaggcccgctgctcttagtaggtgctctggtggcccgtgaggatgtagaggttgctgtgcgcctctgggttgtcagtgggaatgctctccaggatgatgtctctgtgggccccaagcactcggaagatccttgtttcatctgtgatctcctgggtcacctcattggtatccaggctttcgccttgcatcccatggcttcagaaagccagcacactgtcctgcaggcacaccacagtctcgatggggaaatcaaa

SEQ ID NO: 10805 - DNA, 600 bp, Homo sapiens
gatttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtg

SEQ ID NO: 10806 - DNA, 123 bp, Homo sapiens
  misc_feature 40, 53, 106, 121: n = A,T,C or G
acggagacgggtatcccttcgacgggaaggacgggctccnggcacacgccttncctcctggccccggcattcagggagacgcccatttcgacgatgacgagttatngtccctgggcaaggncg

SEQ ID NO: 10807 - DNA, 150 bp, Homo sapiens
gggtcgacgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaa

SEQ ID NO: 10808 - DNA, 516 bp, Homo sapiens
tccaccgcggtggcggccgctctagaactagtggatcccccgggctgcaggaattcggcacgaggtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgc

SEQ ID NO: 10809 - DNA, 445 bp, Homo sapiens
tggtacgcctgcagtaccggtccggaattcccgggtcgactactactactaaattcgcggccgcgtcgaccttctggaggaatactgttggcgttcaaaagcattgctgtttcaacaatggccaataacaaattaagagggccgaagtccaggaatgtatttcacatatccagccaaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgatatgaaagcaaaccagttaatgttgatgaagctacaagattaatggctctgttgtaatatactggtgatgcatctaattct

SEQ ID NO: 10810 - DNA, 477 bp, Homo sapiens
tccaccgcggtggcggccgctctagaactagtggatcccccgggctgcaggaattcggcacgagtttttttttttaaaaaaggacaaaaatgcatttatttaatatacaagggctcaaccgaggcttattttaaaagacaaaaacaaaacaaaaataccacagctcaaaataaagagtcctatacagaaatcacaaaaaggacagaccatctaaggaaaaattaaaaagacgacacaaggacaggctgggcagcctgggtcagggctcctggctggtgacctgctttgagtaggtttcttgcaggtacttcttaaaagctgtggggtttttccaaaactcggcagcatgtgtgttcaagggactatcaatgttgggttctcctaaaaggctctggatggagagcaaaatggtcctgacatcatacagggcagaccacttttccttcaggatgtccaggcatatgttaccctgggtgt

SEQ ID NO: 10811 - DNA, 621 bp, Homo sapiens
tccaccgcggtggcggccgctctagaactagtggatcccccgggctgcaggaattcggcacgagctttgtttgccatttcctacaggtgaaacgccatcattaggattcactgtaacgttagtgctattaaactcactagcatttttattaatggccgttatctacactaagctatactgcaacttggaaaaagaggacctctcaaaaaactcacaatctagcatgattaagcatgtcgcttggctaatcttcaccaattgcatctttttctgccctgtggcgatattttcatttgcaccattgatcactgcaatctctatcagccccgaaataatgaagtctgttactctgatattttttccattgcctgcttgcctgaatccagtcctgtatgttttcttcaacccacagtttaaagaagactggaagttactgaagcgacgtgttaccaagaaaagtggatcagtttcagttaccatcagtagccaacgtggttgtctggaacaggatttctactacgactgtggcatgtactcacatttgcagggcaacctgactgtttgcgactgctgcgaatcgtttcttttaacaaagccagtatcatgcaaacacttgataaa

SEQ ID NO: 10812 - DNA, 64 bp, Homo sapiens
tccaccgcggtggcggccgctctataactagtggatcccccgggctgcaggaattcggcacgag

SEQ ID NO: 10813 - DNA, 502 bp, Homo sapiens
  misc_feature 478: n = A,T,C or G
gaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctggcatttacagcagagggaacatctcacacccttggcataagttaaaataaatattacgtacacatctccatcaccctaggagggacgtacataaatacatataaatattaattagggaggcaattaggaaataaattaacgangctctcctttcccacggggctagg

SEQ ID NO: 10814 - DNA, 522 bp, Homo sapiens
tccaccgcggtggcggccgctctagaactagtggatcccccgggctgcaggaattcggcacgagcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttcttt

SEQ ID NO: 10815 - DNA, 147 bp, Homo sapiens
tccaccgcggtggcggccgctctagaactagtggatcccccgggctgcaggaattcggcacgaggcagctggaggaggagcagcaggccctccagaagaagctgaaggggacagaggatgaggtggaaaagtattctgaatccgtga

SEQ ID NO: 10816 - DNA, 494 bp, Homo sapiens
  misc_feature 219, 251, 305, 379, 483: n = A,T,C or G
ctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaanctggtcctcttggcattgcggccctcctgggnccggtggtcctcctggtgctgtgggtagtcctggaatcaacggtgctcctggtnaaaactggtcgtgatggcaaacctgggaacgatggtcccccaggtcgcgatggtcaacccggacacaagggaanagcgcgggttaacctggcaatattggtcccgttggtgctgcaagtgcacctggtcctcatggccccgtgggtcctgctggcaaacatggaaaccgtggtgaaantggtcctttgg

SEQ ID NO: 10817 - DNA, 647 bp, Homo sapiens
tccaccgcggtggcggccgctctagactagtggatcccccgggctgcaggaattcggcacgagcaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtcactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctgc

SEQ ID NO: 10818 - DNA, 720 bp, Homo sapiens
  misc_feature 3, 624, 661, 663, 668, 669, 673, 674, 676, 680, 681, 690,691, 692, 698, 705, 709, 716: n = A,T,C or G
agnatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgggaaatgactcaatttctattgtggtaagctcattggcagcttagcattttgcaaaggaattgctttgcaggaaatatttaattttcaaaacataatgattaatgttccaattatgcatcacttcccccagtataaatcanggaatgtttgtgagaaaccattgggaactatactctntnaattnnaatnntnaatnntttaataannntttttnggggacngagngtccctnttgt

SEQ ID NO: 10819 - DNA, 845 bp, Homo sapiens
  misc_feature 7, 8, 23, 24, 27, 30, 61, 85, 88, 105, 116, 121, 129, 218,300, 316, 326, 327, 331, 332, 437, 439, 440, 441, 443, 701,712, 739, 746, 750, 753, 758, 759, 763, 767, 770, 804, 815,816, 839, 840: n = A,T,C or G
gggtggnngggttttgttggggnnaantcnattgttcaaaaaccccccctttttttctttnggccgaaacccctccggctgcganaanagacagtaggggcaagnaatggctttgnggggncttggggngagtcataaaagttctaaagcaagttgctgaacagtttctcaacatgaggggtgggcttggtttatctggtgcaaaggccaactaccgnggaggtgaaatccgagaacagaatggagacagtcttgtccatgctgcttttgtagcagagggggctgtcgcgggaagtgcanaggcaaatgcatttantgttcttcannatgnnctcggtgctgggccacatgtcaagaggggcagcaacaccaccagccatctgcaccaggctgttgccaaggcaactcagcagccatttgatgtttctgcatttaangnnngntactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcanattgattcagnggctaatgctgatatcataaatgcggnaaaaaanttgnttntggcnnagtnatanccncaaggggaattgggactaccctttggtgaagagngaaactgagcnncttacaggaaaagctgacgtctnnaaccc

SEQ ID NO: 10820 - DNA, 216 bp, Homo sapiens
  misc_feature 94, 142, 145, 159, 160, 166, 190, 192, 193, 196, 200, 201,203, 204, 206, 207, 209: n = A,T,C or G
gggctgtggtccccattactcaggaggctgaggtgggaggatcacctgagcctggcaggtcgaggctacagtaagccatgatcatgccactgcnctccagcctgggcaacagactgagaccctgtctcaagaaaaaaaaaanatnaaaaaaaaaaaaannggggcngtttttttctttttccccccctgntnnaanatcnntnntnntntttggac

SEQ ID NO: 10821 - DNA, 545 bp, Homo sapiens
  misc_feature 8, 437, 472, 498, 502, 512, 541, 542, 543: n = A,T,C or G
gggatggnccccaactctggcttaaagatcttgctgtggctctgttatgttctgaggccttgggattagcctcttcctcattacggagctgattttctagtctgtggatcagctatgcctttggacacttctcttttccattgtgccttttgaatgttgtcttctcactcagcatcagcacttcgatctaaatgcagactagggagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaatacatgttccttggacagaggaagaaaaccncgaaaccctggaattagggagcctttcagaggggngacaaactcaatttgcctttcagctntgtncatgatgtgncctgcagatgctcataagtatttctgccnnnaa

SEQ ID NO: 10822 - DNA, 126 bp, Homo sapiens
  misc_feature 2, 18, 28, 31, 40, 53, 57, 67, 70, 73, 74, 79, 94, 96, 98,103, 118: n = A,T,C or G
cnggtactggcttgccanaagaccacanaanggtacctgnttgccagatgacnacancacaggtacngtntgnnataanactacagaaaggttntntntgtanaagacaacaacctgntacggctg

SEQ ID NO: 10823 - DNA, 788 bp, Homo sapiens
  misc_feature 1, 9, 26, 623, 641, 647, 649, 669, 671, 672, 691, 694, 740,750, 752, 759, 761, 765, 776, 785: n = A,T,C or G
nacgacagnagggtatttaatgagtntcttgttataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatggttgctttgattactgnggggggaagatgaaatgntcattntnttaaacaacaagcttttcanannactggtttctgcccttganggntaaagaattaatcatgccttaatcccgactttggaggcggggcagnggatacctgnanaagagtnanacanctggccaatgnaaaaccttnttc

SEQ ID NO: 10824 - DNA, 723 bp, Homo sapiens
  misc_feature 1, 8, 571, 583, 606, 690, 691, 700, 708, 714, 719: n = A,T,C or G
nagacagnaggggattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagacgcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaatttgggaactacaaatcttttagtagtanagttaacgtgtntagctaaagtgaaagtactgagngtctcttgttctttgcattaaggactggggggttgccttggcccctggtaaaacggctttaaaaaattttgactactggaagcnnaaataaccntctttggnggccanccttnttgg

SEQ ID NO: 10825 - DNA, 776 bp, Homo sapiens
  misc_feature 1, 618, 666, 671, 676, 683, 690, 695, 703, 710, 711, 728,746, 752, 760, 774: n = A,T,C or G
nggataaaatgggctgggcacggtggcctgtagtcccatcactttgggaggctgaggcaggcgaatcacttgaggtcagaagtatgagaccagcctggccaaaatggtgaaaccccatttctactaaaaatgcaaaataattagccaggcatagaggtgcatgcctgtagtcccagctacttgggaggctgaggcaggataattgcttgaacccaggagacagaggttgcagtgaaccgagattgtgccattgcactccagcctgggcaacgagtgaaacttcatctccagaaaaaaagaaatgatataaaatgttttattcttatgaagcagtttgcttgagtaattttaatggataacggtgaaaattaaatcactctgggtgtttttattctcacagatgccttttaaaaagtgatgtaagcattttattttaaaataccagtatttagattatagttgaaattacctaatcctttgcaactattttgttactttatcaaattaaccagtttataatcaaaattccaggtgacagtctaattggcaaagggtgcatacatttttcaaagtattttatgagataagtgaataaaattggggagcattgctcgaggnctcggaattacctaggattggactgtgagtcatgggatcagtatttanctgcnccagngaggcancctgctntcagngggggccnctggctnnatggaggtgctccttangggggcctgggctggatntacagnggctaggncattactgttaagngg

SEQ ID NO: 10826 - DNA, 454 bp, Homo sapiens
  misc_feature 289, 378: n = A,T,C or G
gcgtgcgcgcaacggggacgactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggngtgtcgctccagacctatgatgacttgttagccaaagactgccactgcatatgagcagtcctggtccttccactgtgcacctgcgcggnggaggcgacctcagttgtcctgccctgtggaatgggctcaaggttcctgagacacccgattcctgcccaaacagct

SEQ ID NO: 10827 - DNA, 337 bp, Homo sapiens
tccaccgcggtggcggccgctctagaactagtggatcccccgggctgcaggaattcggcacgagaggaggccaaggcgggcagatcacgaggtcaggagatcgagaccatcctggctaacacggtgagaccccatctctactaaaaatacaaaaaattagccgggcgtgttggcaggtgcctatagtcccagctacttgggaggctgaggcgggagaatggcgtgaacacaggaggcggagcttgcagtgagctgagatcgcgccactgtactccagcctgggcgacagagtgagattgcatctcacaaaaaaaaaacccaaaaaaaccctcccccc

SEQ ID NO: 10828 - DNA, 394 bp, Homo sapiens
cttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctgcaatatttgtgactgaataggaaaataa

SEQ ID NO: 10829 - DNA, 270 bp, Homo sapiens
  misc_feature 146: n = A,T,C or G
agctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcangagagactggagagaaagaagagaatagatgaaatcatgaagagaacaaggaaaagtgatgtgtctccacaagtgaagaaagaagaccccaaagtgggggtccagcctgctgtgtgtgtggaaa

SEQ ID NO: 10830 - DNA, 403 bp, Homo sapiens
ggcttttgcctttttgtcacattgagccacatgcctttgatacacagttgtagcaaagaagggaggtgatgaacttgctcactttcttttctgatttccctccctactcatcctgcactccccacagaaacccagatatcttatagtctaaggcttgtagaggattaaggaaaggaattggagatgggttttacttaattcacagaaaagctttctttgggatttttcctcccccttatggcttttaagtctaggtgaagtgaaagttcacacatgtgtttgtttggttgctctgtaattagctactaatttttatccctagaccttctctgctccagtgtcttgttcatgtgtcctgaccccgagtccttgaattcccactttgctttgagatttaagttat

SEQ ID NO: 10831 - DNA, 622 bp, Homo sapiens
cggcacgagttttttaactactgtgataatcaactttgatcctaacaatttaagaaatttgtataggaggataagaagaaccctaatctatagggaatgctcatgtccctgaaggaggacaggtcagtaagggcccaaattctctcctggtctttaggtggaaaggcaaaacatcacactttaaaaagaggctgctctcagccaaagcaagaaagacctctttcattaagcctattgatctgaagctattccaggaaggacaaaaaaagttcaagccagatgttcagcagcagccagagttggaccctatgtcacgagagttccgctgggaggcactgggtcccactgatgttgaaattgactgttggggcccaatcttgatgccatttgcctcattgtggacatcaaataaaccctgctggatcttcctatatatttctttggctgtgttaatgaaggcctcttcaacattgcaggctgttttggctgaagtttccatgaatataagtccatgctccctagcaaaggcctctccttcttctctcttcacatccctgcgggactctaggtcactgtaatcccagctactcgggaggttgaggcaggagaactgcttgaacct

SEQ ID NO: 10832 - DNA, 606 bp, Homo sapiens
  misc_feature 489: n = A,T,C or G
cggcacgaggggtcggactcccgcggccggactgtgggggagtcacgcaacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgtggaggtcattangaggttgtggaaggatggtggggtgcaagcctgcttcgagagagctgcagaataccagcttaatgactccgcatcttactacctgaaccaattagaacgaattacagaccctgagta

SEQ ID NO: 10833 - DNA, 592 bp, Homo sapiens
ttcggcacgaggtgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtatagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcctcagatattagaattaggtcacactattgaggttataatctgaaggttgtgttacatacaaaccactttagattattatcaacttggactaggctttattttataatagcataggaagtaatatctattgtgtcatttcttcaaccattttattctaagatccatgaagcttcttgaggccaaataaaataataagtttacacaagaagtagattgtgactgtttttcccttagagatactatttactatctcctatcctgat

SEQ ID NO: 10834 - DNA, 630 bp, Homo sapiens
ttcggcacgaggcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctga

SEQ ID NO: 10835 - DNA, 781 bp, Homo sapiens
  misc_feature 1, 8, 17, 31, 484, 555, 657, 670, 732, 749, 752, 766, 768,773: n = A,T,C or G
nagacagnagggtcggnagcgggcgagcggnattagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcantattggaaggaagcggcagaaaaacggagaaaggcgctgtatgaagcacttaaggaaaatgagaaacttcntaaagaaattgaacaaaaggacaatgaaattgcccgcctgaaaaggagaataaagaactggcagaagtagcagacatgtacagtatatggcagagctaatanagagactgatggngacctctggtatttgaatcctggatatcaggaatttgattctgaaaaaaactgtgagatttntatgaaactcaaattgnacnggctgaaggactgntnttctntcgatgca

SEQ ID NO: 10836 - DNA, 726 bp, Homo sapiens
  misc_feature 439, 578, 613, 620, 628, 632, 633, 643, 650, 667, 681, 685,696, 698, 699, 709, 717, 718, 724: n = A,T,C or G
tagggtatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcangaagagctcgtggaagaagtggtggccccagtcaaaactggaaccagggatatagtaactattggaatcaaggctatggcaactatggatataacagccaaggtaccgtggttatggaggatatgactacactggtacnacacctactatggtttggggattatacaccaccanagtggtntgggaagnatcnngcaaggggcntcaaatnctccaaccttctaattntcctttgcactttncccncaggggggaananntttccatttnaaatcttnnaggggntc

SEQ ID NO: 10837 - DNA, 355 bp, Homo sapiens
tacttgttctttttgcaggatcccatcgattcgaattcggcacgagccccaaccctccccagtgggcagggcggagggagcctcagcctccttagactgacccctcaggcccctaggctggggggttgtaaataacagcagtcaggttgtttaccagccctttgcacctccccaggcaaagggagcctctgttctggtgggggccacctccctcaaaggctctgctaaccacactccgtggcccaccctttgttaccagttcttcctgcttcctcttttcccctgcctttctcattccttgcttcagatacctttttgttcctttgcctcttgcctgtgccctaaaacttgactg

SEQ ID NO: 10838 - DNA, 716 bp, Homo sapiens
  misc_feature 26, 85, 281, 430, 687, 700: n = A,T,C or G
ggcacgaggcaaggttgtgacattgncacttttttgttctagactcttttaaattttctgcatttgcctgaaaagcacccctgtnagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacaagacctcttcaaaaacccacantaaaactcccctccctccagttggccaccagtctgccaccaaacatgaacaaattctgctgctaatcggtttcccttgtgatctggttcctgaggtcttcggatctgtgcaatgaattatttattgttttattaaaccgacagtggtgncccagagaggaaccataaataaaatggaaatctggtgctgtgataaagtaataactagcattaatgagacctggttttcctttcagaaagtccagtatacctgtaacaaaggttaaagcaatttatatttaatttgcattctgatgttaacatttaaacagcaattctaacaaaaatgcatcgagtctaattcttacctctatcaaaaaacaactgtataaatttatgaccaacattaaaacaaaaacaaaatgtanattttctctttanaaatgataactgggaa

SEQ ID NO: 10839 - DNA, 572 bp, Homo sapiens
tactcttgtggcaaaactgctggcaagtgtaccctttctgcagaaagtaaaaatggccttgctgaggaaattaaatttatgttcaagtgctatcctttacagcaccagggaacaagcatttctaacaatagcttatatttactacttaatgtttgatttacttttattgcaaataaggtcaaatcaaacatttacaaactggtacaataatacttttttgtaattagatatacaccaattcatactgacaatataacaaataattgtaatattcagttctagtattctactcaccacaaatccaacatttatttttccttctctattcttcctgctgaaaatgttaatctcttcagacaattatttgctatgaattcaaataactgctccaatctaataattgttcatataattcatcttaaatgatacaggtgaaataattttctcttatggctgacataagacagtctttaattacaaaaacaattaccataaaaaattgtggccattatttccataactatctttctttctcctcccttccacttctgggacttcagttgcaggtttgt

SEQ ID NO: 10840 - DNA, 353 bp, Homo sapiens
caagctacttgttctttttgcaggatcccatcgattcgaattcggcacgagccaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaacaaaaaaaactagccaggcatggtggcaggcacctgtagtcccagctactcgggaggcaaaggcaggaaaatggcgtgaacctgggaggtggagcttgcagtgagccaaaatcgtgccactgcactccagcctgggtgacaaagtgagactccgtctc

SEQ ID NO: 10841 - DNA, 623 bp, Homo sapiens
tgacactatagaacagtttgtacaaaaaagcagctggtaccggtccggaattcccgggatatcgtcgacccacgcgtccgctctacttgattctacatcagtagcatgtctttgttttaaagctataagattatccagagttatttttgaactagtaaaataatttaattatggtcaaaataaacctaagtattccaatttcaataccacatataatttaatgtgttttactataacttgtgctgtctgcatataatattcaaataaacacattgtgatgttatattggtacacagaaaaaaaatctgcactgaatcaatcctttgacaccaaatagatgtgtttatgtataataataggaatgacagacatgcctgactcacacactacaatatacagtaaagtcgtacatgatgcagcagtgaaagtgaaagtgagtgtagtcccaccaaaacaataaagtcaaagaggagggccaaagagttctgtttaggccacatcaagtttgagaagcttatgaaacattaaaatggctgtgccatgaagcagtaggcactaccgtgaccaccctatctaaaactgccaatccggccgggtatgatggttcatgcctgtatggcatg

SEQ ID NO: 10842 - DNA, 521 bp, Homo sapiens
ccaccccaaagatattttatttactttaagagtttagcatacataattcaaaaaatacgcaaactatatattttatataaaaggaaatatatgtaaattttacaagttcctttttcacttcatatatactatagctatcttttcatctgaatttatatggatttacctcattctttttaaaagctacatagtattccacggcacaggtgacacaatgctgagggctgtcagttgagcctgattctcttctctgtacaattcagcgacctgagtctgagtaaggcgaggggagtatggcacttgagttgacggcgcgactcactcaagcaaagactgattaaaggtgcaggaaggctaattgcccatcacctcctgctcaccatctcgggctgtcagtaggatttctttttactcaataatcatatagactagattttcctcattccaggtttcaaaattccctgaaatctaagaattttgaaaaaaatcataataatacatgagcatattctatctgactg

SEQ ID NO: 10843 - DNA, 405 bp, Homo sapiens
agaacaactcagcaaaataaaattcctgtttattgttggacaacattgtttcacacatacatcaaacaggccaaaaaaaataaacagcaacttcatagacaaaaaaggaaaaaaaaagaaaccttttatctttggcctttttaaccatctcatacaaaccaactacttatagtacagctaagtacatacacaaaaaagttactggaatgctcggaataagattgtttttctgttgtcatttttgctttttttacaaggttttttttctcctttgagattataatgaacatggtcacaccacaagtaaagtcagaagtaggacagagaacgctccgaaggctggtttggtcatccgagatcattaaaaatggctgaccctaacaatatgtacaaaaatataaaatg

SEQ ID NO: 10844 - DNA, 393 bp, Homo sapiens
ctgacccgaaacataaaaacttttaatgaaggaggacccagttcaaagcccttccacatgcggcccaaccctgccccacggaaaccggccatggcaaccgctcaatcaaaaggggtttttgatgcggccggccaccaccctaaggatgtccccgatctttttttgccagttggggatgtccttggacacggggcaccacagttccccatgccgaggctttgcactttcacagggcttccttacctcctcctgctgctcctaagggccatgctgcagctcaaacttgtagaagaaggcccaggcatcccccaggtccgagtcaatttcacaggtgcgggggaaccactccctgcctttggtgatcttccgctgactccaaaacagcttgggcac

SEQ ID NO: 10845 - DNA, 688 bp, Homo sapiens
  misc_feature 631: n = A,T,C or G
tcggcacgaggtcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattangcagggtctgtcctgtggccacctggaaagtcccaggtgggactcttctggggacac

SEQ ID NO: 10846 - DNA, 621 bp, Homo sapiens
  misc_feature 612: n = A,T,C or G
gcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggctgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcanaggaccggg

SEQ ID NO: 10847 - DNA, 789 bp, Homo sapiens
  misc_feature 481, 561, 627, 730: n = A,T,C or G
ctggggagaacagtgatttaataaattatgggatagaaggaaaaatacatgtggatggtggggtgcagagagaccttgggcacagggactccctccgaccccagattatagaagactgatttggtttctgaagtaaaatcaaggcaggatccttcctgcctttggtcctcaagtagccagaactccagacccaaattccttcctgcctcaaaatccaggccccagcctgtttctttctgcatcctggaaagacctagggaatccaagctatcatccctctcctccttcagggaaccaggaatccagatccccagctcccataggactcatctgaagcccaccagaccactctctcctggggaaaccagagtttgggataccagccccctcctcccacagcacccaggagtctgggagcccagccctctgctcttccaggaatctgggctcaagtgggtgtccagagcttgaggatgcctgngctgccgacccagccccctcgtcacttagacctccaacttgtgggcctggatggcggccacgttctcgtagatgaggttntcgacatcctcatacgggacttccttctccgctgggggcctgggcttgactgtggaggaaccgcangatgcactgatgcagggattcgtactgagccctaatctgcaccatcaacgggcgactctctctcatcctccttacaaagctgaagggcccaaggagaccctcngactgcagctgcccgaagcagacctcccagggcaaatagggtgctgtgcgaccaagccc

SEQ ID NO: 10848 - DNA, 661 bp, Homo sapiens
ctggttataaatatattttaatatcaaataaaatgtacatgatcaaaaggctttgattgccatgtaaagcatagtttccaggttacatcaagtgattttatcttctcccatttcaaatgaaatgttgaaagcacaaacaatctgccatgaatgataagaagcaaaggcagcacatatcatctgcaagtttcttcccaagctataaaatatcatgttcatatttttcctggttggggaatcccaaaacaggcaatattttcatttcatccactctattcttatgtatttgaaaagcaggtgttatccacctaccacaagagcactgttcaccataccagttgaaggaacccaacttggcactgcattttgggcaaagaagctgtccatccatcactcccaacaaagcagattccatccactgtacaggttcaatgaaataagatgtacattgagcttgcctccctgtggtaagcatggaagatggtgtcattctcttgtgggcaaaggctataggtccacttccttcacggtgatccagaatactagaacttcgaaataatgatcgcctgcactttctacacttgtagagaacctcatctttcaatccttgtgaaacggtagttgggtcaacagcaaagagttcttgaagtaaattctgcaa

SEQ ID NO: 10849 - DNA, 826 bp, Homo sapiens
  misc_feature 2, 8, 12, 21, 22, 30, 45, 52, 63, 74, 740, 764: n = A,T,C or G
cntttggnccanaaaaacccnncttttctngttcttttggcccancggcctncggctgcgagnagtacgacagnagggggtagttctggacaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccagtgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcggggcatcaggtgcaactgtgtgtgcccaggaacagttgatacgccatctctacaagaaagaatacaagccagaggaaatcctgaagagcccggaatgatttnctgaaagacaaagacggaagatcncactgcgaagaatagcctgctctgcgtgattggcttctgagatctgctatgtactggaacct

SEQ ID NO: 10850 - DNA, 626 bp, Homo sapiens
gaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcct

SEQ ID NO: 10851 - DNA, 891 bp, Homo sapiens
  misc_feature 647, 661, 680, 693, 694, 695, 735, 737, 739, 740, 759, 791,797, 848, 883, 884, 885, 886, 890: n = A,T,C or G
tgtgccgctttcgcaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccataacaaaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaagcctgcaattgcagattacgcattacaacattaaagcctgaacttggaagatatgtcagtgatttcaacagatatcagtagctgatcttcnggttatagaagacncattgaacaaggatggccncaattctcagctnnnaagactaacactcttttgtgtgatattctggattagcttntntnnctcatcagacactttgacntatctgttcaaaattgattgccaaagactcanaaactnctttgcgtataatgctgcaagccaaagtctgatgtaccctcaattaatttnttttaaaaaaaaaacctgccttctacctaatgtgnnnncccnc

SEQ ID NO: 10852 - DNA, 729 bp, Homo sapiens
  misc_feature 678, 698, 701, 708, 728: n = A,T,C or G
aggggacaacaaagggcatgtcttgacatgcagagatgcgtagactacctgcaaataggcgcatatttttttaaagacagtagttagttccaaatatattattttatggatgaacaatttaatctaaaggggactatatcaggatattggaatcacttattgggccgtaagaattgaaacctagatcaaataaatttgagtagaaggaaaaggtaagagaatgacacaaaaagcacccagaggagagtatttctgtgtaaacaggtaaattaataggtggatatttaatacacaaattcacatttgtttcaagattggccttgtgtgtatggatactaaaaaggaaataacactaatgcttcattcatttttttattccaaataattttgctaagccccattacatagccaactcactgttagacactttgttttaaaggtgaaagagttaatacatttgcttccaaagaacttactagtaaagttacacacacacacacacacacactcacacacacacacatacacacacagagaatgagagagagaattacgtattctataggaaataaaggtaatatagaaaatctaactaccattcactgtaaattttttaaaaggaggattttacttatcaattttgaggataaaaaggacatcttcaatatgagtctaaanatatgcagggtgtccggggnggnggctacncctggatcccacacttggang

SEQ ID NO: 10853 - DNA, 773 bp, Homo sapiens
  misc_feature 676, 734, 741, 765, 769: n = A,T,C or G
ggggtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcacagaggcaaagtaagcttgatgatggttaaaatcggttgatagcacatgggacattttctacaaaataatgcatgaagagnatagcctttagtttgctattgtgaatggaatgcttcaggagtaatcaatactttagtngcttaanaaattttccccagaaattaataanattnttgt

SEQ ID NO: 10854 - DNA, 276 bp, Homo sapiens
tatgacgtcgcatgcacgcgtacgtaagcttggatcctctagagcggccgcctactactactaaattcgcggccgcgtcgaccacaaaagcacactctaatgcctcatgtgaagaggtgggctctccacaagttcccggggcagagtctgaagacctgctgctggataggggcttcctcctggtccccaagggggcggcctctcaggcccaccttgaggccaccctggtgggccacttcccggattttggacaggattgattggagccgtccgttc

SEQ ID NO: 10855 - DNA, 585 bp, Homo sapiens
  misc_feature 565: n = A,T,C or G
ctttctttgctatttaatgttcatcacttaacgttttgtgtgtaagtttcaggagggcccaagaaatgattacacaggaggcaaggaggggaggtgataggagggttgctgggggtctggagctcatggcccccagctcgggggccaaaagggttccatctcagctcaaggggagtaaaaaggggccccagaaccaaacacatgctaaaacatacttgcaagcccccaaaccccctccccacctgctggggaggaaaataaatacacccagactctgtcccactccccaggtgcccaggtgaggggccagcaggtgagtttcctcccctcatcacaggttgaggtcaaagaattgccatttactacagtgctcctagtcccttccacagggctgggggaaccctgggcttgggagcggtggttgtcagcgcacagcctgcctggggcttgtcatgctaaatagaggggagccacactcacttccacttcaggcaaaacagaacaggcccaggaaagggtggaagttcactgaggcctcatggccccctttctggcaggtcagganaaaacagtcctttgcagggt

SEQ ID NO: 10856 - DNA, 295 bp, Homo sapiens
  misc_feature 73, 127, 128: n = A,T,C or G
ctcacacgctgtctgtgactaaagagggcacagcagggccagtgtgagcttacagcgacgtaagcccagggcnaatggtttgggtgactcactttcccctctaggtggtgccagggctgggaggctnnagaaaaagatcagtaagccccagtgtccccccagcccccatgcttatgtgaacatgcgctgtgtgctgcttgctttggaaactgggcctgggtccaggctttagggtgagctcactgtcccgtacaaacacaagatcagggctgagggtaaggaaaagaagagacta

SEQ ID NO: 10857 - DNA, 527 bp, Homo sapiens
  misc_feature 413: n = A,T,C or G
agatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcatccctgactggccaaacccttgctttcctgggcctttgcaagatgcttggttgtgttgaggtttttaaatatatattttgtactttgtggaaaaaatgtgtgtgtgtggcagggggccccgccagggctggggacagagggtgtcaaacattcgtgagctggggactcanggaccggtgctgcaggagtgtcctgcccatgccccagtcggccccatctctcatccttttggataagtttctattctgtcagtgttaaagattttgttttgttggacatttttt

SEQ ID NO: 10858 - DNA, 98 bp, Homo sapiens
tgacactatagaacaagtttgtacaaaaaacaggctggtaccggtccggaattcccgggatatcgtcgacccacgcgtccgcccacgcgtgcggtctg

SEQ ID NO: 10859 - DNA, 459 bp, Homo sapiens
cacagtttaattgctctatgcatttattattagctattattaatgcagaatgagggaacaaaaagctcacaaacactctacacaatttcacaagacgcattgcaggggaaaaagtgactgagatggatcaacagtatgctaaggtcttggtggacgcattcctgggggaggtggacctctaatgcctggtggagggggtctcattcccggaggcggcatgcctattggcgtccctcgagcagggggaagcccaattggtgggcccatgggtggtctcataccaggtggaggagccataatgcctggaggtggggttgctctgccgacgggtgggggcggagtgcaccgtcctggtgggtactgtgttgggggctcagcaatactggcacgtccagcaacagcagcagctgctacagtgcctcttccccgtggagtacatacctggcgggatggtccccc

SEQ ID NO: 10860 - DNA, 88 bp, Homo sapiens
tttgcaaaagactatttagtgacactatagaaggtacgcctgcaggtaccggtccggaattcccgggtcgacccacgcgtccgggcag

SEQ ID NO: 10861 - DNA, 213 bp, Homo sapiens
  misc_feature 18, 21, 28, 32, 134, 148, 162, 206: n = A,T,C or G
caaggcagccgatgtctngancctaggncgtnggcgctcttcaccatgctggccggccactaccccttccaggactcggagcctgtcctgctcttcggcaagatccgccgcggggcctacgccttgcctgcagnctctcggccctgcncgctgtctggttcnctgcctccttcgtcgggagccagctgaacggctcacagccacangcatcct

SEQ ID NO: 10862 - DNA, 645 bp, Homo sapiens
  misc_feature 630: n = A,T,C or G
tgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgattcacagaccactccatgctcttcagcataataaatccactctcactgcaggaactccgaacgttgcagcctgtatgcccgcagtggatccgagcaaanggagacatttgaacc

SEQ ID NO: 10863 - DNA, 498 bp, Homo sapiens
tataataaatgtatttaggtaaaaacataggtgcaattgaaagggaaccactctcgcatggacgctgtgggtgctgcttggggctcgaggccagaggtccctgttggcggggtgggagggtggcccagggcaggcacggggccacacagagccctgatcggggcccactcacctcgagaaatcaccttaatggccacctggacccggtctttccagagcccctcgaagacctccccaaagtagccggaccccagcttcctgcagagcgtgaactcctccctcggcctctcccagtcatccaatggggcaggggctcaggctcgtgcttccggcagggcgcggccagccgacgcgtggggacaggctctgggccctgtggtaattcaccagcttgggcaagcttaagaatgagcaccggctcgttctagttgaagcggcccccgaccgccgccagaatcttgtagtgccgacaagctggttgttccgcactggaacgag

SEQ ID NO: 10864 - DNA, 771 bp, Homo sapiens
  misc_feature 592, 641: n = A,T,C or G
acagcatgtccccctgagtttattattggaaagcaaggactgaacaaagactcagacaataaatatctgaagagaggaagccgagcttaggaggctcagagggtccgggggaggtaaagctgtcgagggcagtgaagggggctgtgcccaccccgctcacccgctccccagatgcctaggggagcgccgggcccggcgggaggtgccggtggggagcccgcagacggtgtcctggcactggcagctctcgatgtgggtgtaggtgtgtgtcaacgagccgccattggggcagctcaggaccacctcacgctggctggttttctcctctttgcagcaggagcagctgtggtccagggcctgggccttggccgagtacatgacaaatgtcccgcaggacccggagcaatgattcatgaggacggtcttggtgcagccggcgtacgaaacctccgtggtgacggggacggtggagcagggcaccctggtctcattgcgaggggtgcaggtcttgcagcatccattgggcatgaatgtgatggagcccgggatgcaaatgctggcatcaaagttggggcaggtgatgttggagacngacgagatgagctggttgttgatcttcacgcagctgaagaatgtgcagntggtcttcggtccctcttgaggtcccgggcttcaggatgacctgctggtggtccggccgtttgagatacgatgcctctgtatcacactgcttcaagacttccccggggccctcattaattcgaccccggg

SEQ ID NO: 10865 - DNA, 465 bp, Homo sapiens
gggcacacatctccagtgaagccaaaaacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctac

SEQ ID NO: 10866 - DNA, 451 bp, Homo sapiens
tgaaccagagagttgtgagtttattaagggagatctagtgcttatcctagaatcagcccttgctgcctatgatcttcttgatccagtccaggtagcggcagatgttggtatagacgccaggtttgtcggacctcccacaggggtctgagccccaggatgtgatgccctggagtgcaccatcacacaccagggggcctccagaatcgccctggcacgtgtcagcccctttgctgctgcctgcacagaccatgccatctgtgatctgccccgggtaagcatcctcacacttcttctggggaaagatttttacttctgcacagttgagagtgtcaggaaaattctctcggggactggtgacagtgccccagcctgagacggtgcacttctggccaggctgggtgcaatgatctgccaggctgatgggcttcactttggaccccagggatgcctg

SEQ ID NO: 10867 - DNA, 523 bp, Homo sapiens
  misc_feature 400, 404, 406, 408, 419, 427, 428, 457, 485: n = A,T,C or G
tgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagagccgagccacatgttactcgtcgtaccccagactacttcctgtaatgaaattttaaacttgtacagtattgccatgaaccatatatccgacctaatggaaatgggaaagagcaacagtaactccaaagtgtcagagaatagttaacattcaaaaaacttgttttcacatggaccaaaagatgtgccatntgcnantnccaaagcctcntgtcatcnncaggccgtgaccactttagaatgtaaccngttcattggcatgctgaagcgacattgntgggtcaagaaaccagtttctggcatagcgccaatttg

SEQ ID NO: 10868 - DNA, 463 bp, Homo sapiens
ggacctttgtccaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcac

SEQ ID NO: 10869 - DNA, 453 bp, Homo sapiens
  misc_feature 207, 208, 209, 285, 340, 341: n = A,T,C or G
atttcaagcataacttgagtctgcactggggagacactcgtggtgggggtggctgtgatgagggcacttgcgagtcccgacaacagacactggctcctgcacccacatcaccaccatgtcccaggggcagcctggaggggagtttgtggtcagagccccagccaggaaaggagagagttccagaatgttccaagagtctagccgcannnccaagacaccatgagctggagggtcgggatggggcagcctccctggtgcaatcggcacctgggcccccgggcatgntcaagtgctgtcgtgaggtctgtctgccctgggtcagagcagcaggcagaaccgnngcttcttctgccgttgcgccttcttcagagcgctgagagccaccttggcggcctcccggaagacgtcctccacattctcccgaaacttggcggaacattccaggtagagagc

SEQ ID NO: 10870 - DNA, 220 bp, Homo sapiens
tgtagtcccagctactcggtaggctgaggcaggagaatcacttgaacccagtaggcggaggttgcagtgagctgagatcacaccactgcactccactccagcctagaaacagagcaagactccatctcacaaaaaaaaaaaaaaagaaagaaaacctaaaaccttttttaaaaaaaaaatttaaggttggggccctcttccaacgggcaaaaaaaaccct

SEQ ID NO: 10871 - DNA, 302 bp, Homo sapiens
  misc_feature 1, 19, 20, 35, 45, 61, 64, 66, 67, 69, 70, 71, 73, 88, 89,96, 105, 121, 130, 137, 138, 141, 153, 170, 174, 185, 188,212, 223, 227, 228, 255, 257, 259, 264, 286, 298: n = A,T,C or G
ntcctgtgcaaggtgccgnngctggatccggctgncagacaactntacaaggcagggaacnctntnncnnngnaccctgatgatgcgnncagtatnctgacacanatgaactgtgtggcanctgctttcnatgcacnnccntggcacaaaccncattttgcgtggacccntagnacaaaaacttntcnaggttggttttaaaaccctttttnggacaaccttnaacnnttaattcccctttttttggcccaaaananangtacnagggttttttttaaccccccancccccggggggntttt

SEQ ID NO: 10872 - DNA, 402 bp, Homo sapiens
  misc_feature (1)...(402): n = A,T,C or G
tgctncgacaacannncagaanggttanngctgcnatnagactacagtatnggttactggctgcgaaaanacgacatagttggtactgctgcgatantacnacaganngggtcntcgtgcgacatgacctananatgggtacggctgctagactacganngatggnttcggctgccnataataccacatangngttctgctggnnctanacnacgaatgnttctgctgctataatacnncttagtggnacngctgcnagaacnctcatantgttcnggttntatatatanccgaagntgcngntgtgatatacacataagntccggtgcaagaaaaannaaattgttcccctcgagttaccacnccctgtttaatgntgnntaatggacnttctcctgnaaa

SEQ ID NO: 10873 - DNA, 740 bp, Homo sapiens
  misc_feature 487, 534, 549, 573, 590, 631, 638, 642, 651, 658, 684, 708,711, 724, 726, 736, 738: n = A,T,C or G
cccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaangggaacgtgcaatatggacagattctaccagctccgtaggtgctganggcttattcctgcangaccttggcatctggctcagtttnggagtgctggtcttcanctccgggatgctgatggggaaagtttggaggaactctccantaaactncctncctcttaanagccagngctcaattccacctgcttgctgcatnaaactctttaaaattatgaagatnggntaaccctgttttnangttgaagcangnaa

SEQ ID NO: 10874 - DNA, 767 bp, Homo sapiens
  misc_feature 2, 12, 15, 22, 38, 620, 647, 657, 669, 688, 689, 704, 731,756, 767: n = A,T,C or G
tncggctgcganagncgacagnagggtctaacaacagnactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatccgctaagaaatttgtagagacccctggccagaagtacaaagaaacagacctgctaatacttttcaaggacgattactttgccaaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaattcatggngaaataaatggatagacttcgtcagangagcaaagangggatatttctntttaagaaaagccaggaannttgggtaagccaagngcaatatggtacctcattaagaccaanaatgcttgggagtctaaaggggagnggaaagaaccn

SEQ ID NO: 10875 - DNA, 778 bp, Homo sapiens
  misc_feature 5, 20, 533, 569, 630, 659, 686, 704, 743, 746: n = A,T,C or G
agggnattgcagactgcggnagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccacggaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagcttggagtccaataagatcccagagctggacatgactgangtggtggcccccttcatgggcaacatccctctcctnctctaccctcaggacgggccccgcagcaagccccagccaaaggatatggggacgtttgcangactgcattcaaatggtgactgacttcanactgctgtacggaccactcacctttgncagccttggtgaactgtnaggaggatggacgctggcctgctgccactttcaaacttntancattttgaatgttccaaaatgtccttcaccag

SEQ ID NO: 10876 - DNA, 769 bp, Homo sapiens
  misc_feature 1, 8, 14, 29, 36, 547, 719, 733: n = A,T,C or G
ncgacagnaggggnacttttgtaaacagnatcaggnaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaanatgaaaaatgagatacaggatctccagacgaaaatgagacgacgaaaggcatgtaccataagctaaagaccagagccttcctgtcaccccttaccaaggcataattgaaccattttagaatttggaacaagcgtcactacttttgataataattagatcttgcttcataacnccaaagttattaangcatgtggtccatgatcaaaatctgttttttttaaa

SEQ ID NO: 10877 - DNA, 751 bp, Homo sapiens
  misc_feature 18, 641, 647, 671, 687, 700, 704, 727, 749: n = A,T,C or G
ctcccctacattccaggnaggcgaaagctatgcactgcgcagaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttagagagtatgatggaaggtctgatcttcatgttggaataactaacacaaatggggttgtgtataattacagtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaaggtagacagcaactggacaagggtgaatttacggagaagtacgtggtcccgcggacaaggctggcattcaagttcatcacactctaccgggcgatacgggagcatggcttntacgtnactgactggccccagcagcaggcncaacccctgaggcggnggtttggctgaancttntaacccaccctggccctgaaggnaggggggtgctacctttaaaanac

SEQ ID NO: 10878 - DNA, 759 bp, Homo sapiens
  misc_feature 557, 716, 728, 741, 748: n = A,T,C or G
cggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctnctgactggcaggagattttgacttatttccgtggatctgaatacaaaatactttacaaagattctagagatgacctaaagccatcatcaacctcatatgtagaccagattctaagctgcaaagggacagtgggatctatttgaccgaaagataaacaanaccagcaatggntgtcagcgcttgnttacccnctaaaaacaaa

SEQ ID NO: 10879 - DNA, 783 bp, Homo sapiens
  misc_feature 9, 30, 549, 572, 577, 606, 618, 620, 661, 672, 681, 688,726, 732, 747, 757, 779: n = A,T,C or G
tacgacagnaggggccttcccaggcggggnatgctgcggctccgcagcgggctgaggcaccttcgcgcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccgaacaaaatgctgtaacagatttgacagcagaggctgtaaattagctattgcagcacctccatcagagggagaggctaatgctgagctctgtcggtatctttccaaggtcctagaactcaggaagagtgatgtggttttggataagggtggtaaatctcgtgaaaaggtggtggagcttttggcttctacaactccagaagagatcttggagaaattaaaaaaggaagccaaaaaaacataaaagcaagaaatgaggccgggcgcagtggctcatgcctgtaatcccagcactttgggangccgtggtggcggatcacctgangtcangagttcgagaccagcctgaccaacatggngaaacccatctntngaaaatacaaattagccagatgtgatggcgctgcctgtatnccagtactcangaggctgangcagganatacttgacctggggcggaggtgcagtaaccgaatccnccgtgncttcacctggcacanatgaactctntccccgaaaaaaataaaaactncttg

SEQ ID NO: 10880 - DNA, 424 bp, Homo sapiens
ttttgttttaaataataaaactcaggatattttaattggacattagcacaaagttttgataattaatgtaaatgaaccttgtctacaaagcgaacgatgcctgctggtgagccacacagatactgctccttcagattgaggttgtacatgcccccaaaggctcgcttcattgctacgattctctacttaaatccacattcacagctattgcctcagaccctctggaggaggggccaggggttagctggctttgaatagcatgtagagcacaggcagtgtggccacaaatgtcacacaggtgaccagggtgctatagatggtgttcctgttgacttgggcttctagtctctgctccgtgtctgacagtgccaagatcatgctcccctgctccagcaagaagctgggcatagccccgtctgctggt

SEQ ID NO: 10881 - DNA, 610 bp, Homo sapiens
tccaccgcggtggcggccgctctagaactagtggatcccccgggctgcaggaattcggcacgagactgcctctgccctatgcagctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggac

SEQ ID NO: 10882 - DNA, 698 bp, Homo sapiens
tcggcacgagtgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaag

SEQ ID NO: 10883 - DNA, 440 bp, Homo sapiens
  misc_feature 2, 71, 137, 181, 272, 404, 411, 420, 428: n = A,T,C or G
anttatttggtttctaatactttgaaattctacttttagttaaagtcttcactggttttggggagcctccnaaaacttgtttggagctcactgggattaaaaaagaaaaacaaacttttaagtaaaagttaatggtnttaaggtaactagctcagcatttttcaagttagatacatatgangcgcctggcttagtgtgaggtacatatcagctgttcagttattgctgggtcagcaactctactaagacttataaatagaggagcagtggtnttgggcagcatcagggcatggccagggcaggagcagcggccacagcgttcatccatctatgggaggaagaggctgccttggcggggtcaactgtgttgctccaagtgacataatgtcatgattttgatagcncgaagtnttttgcccngtgtacanactagagtttcc

SEQ ID NO: 10884 - DNA, 571 bp, Homo sapiens
acacaaagattctatttatttctcttacttttcagttcaagtaggagagcatgttttggaaataaaagaactgactagcacaaacatctcctctctgatttgacaacctcttctgaagagtgaaccacatttggtacaaatccactcttcaccccttcccagccctcctggattgtaatctccccccttttaaccagctcatatatgtctcttgtcaggtctgtgaaggctttctccacattaatggcatctcgggctgacgtttcaatgtacttcatgccgtatgcagcagccagtttctcggcctcgtggcgagtcacttgcctctgtgtatccaggtcacacttgtgacacaccagaacaaatacaatttggtagggctgaacgtgtactttggtctcttctaaccactcatggacattctggaaggacctgcggttggtaatgtcaaataagagaagaccactactgagttcctgtagtaggcgcgagtgatggatctgaactctcttgacacgggtatccagatctggagcttgatgcgtgttcatggctcgatctcacaaagcgg

SEQ ID NO: 10885 - DNA, 203 bp, Homo sapiens
caccggcgcaggctaggagggggcggcctgagtgccgtacccgagccggggctggagcgcgcggcctgacctactaaaacatggcaaccaacgccgtcccgggggacaacctaacccacctacaatctgccggtggtgggggatgggggtggaaaaaaattttggggccttttcgggaaaaactttaaaaaaattttggaaaa

SEQ ID NO: 10886 - DNA, 605 bp, Homo sapiens
tcggcacgagggagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggt

SEQ ID NO: 10887 - DNA, 389 bp, Homo sapiens
  misc_feature 279: n = A,T,C or G
aatggaaaagataagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcanacctccaatgcatgtacagaaacctgtgatatttatacccttgtaggaaggtatagacaatggaattgtgagtagcttaatctctatgtttctctccattttcattcctc

SEQ ID NO: 10888 - DNA, 475 bp, Homo sapiens
  misc_feature 251: n = A,T,C or G
aagcttgcggccgccgcccgactcccggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggangcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccg

SEQ ID NO: 10889 - DNA, 797 bp, Homo sapiens
  misc_feature 524, 570, 787: n = A,T,C or G
atgcagaggaaataatataattcctttatttgaaaaatgatactgaacctcagagatcagttaaatctactgctggaatggggattctttctaaaccgtgttgttccctctcttcaaacagctggagctgtacacagatggaaaaacatttggtcagaaagcagcaaattagtgtttttcaggaccgaattcggctcccgcagctcctgcatctccattcgtctagattttatttcttctttgcattgacatttttgcagacccagttcatgccatcctgaacgccctctcctgtgagagctgagcaagactggatctgccagactcggtcgcggatggtatgcaggttcagtccttctgcaatttcagaggcaggggctgctgtgagcaaatcctgcttattagcaaagatgagcactggcacacaacttagtttttcttcctccagtaattccgctagttcctgacccgtctcttcaaatctttttctgtctgcactgtcgattacatatataagaatatcngtattttcaaaataattcttccagtatggtctgatttttctctgtncaccaatgtcccatacattcagtttaaaaccttgtgattgtacacttttgatgttgaaaacctgtgtaagtgtgatgtggctgatgtcttcagatgcaagctgcttccagagaagtggtcttgccagcattaattcaaccccaagagaagtattcttcacctcctggtctggtgcaccttttcactttggcaaaaatggaaagaaggccattccttngccgagatcc

SEQ ID NO: 10890 - DNA, 752 bp, Homo sapiens
  misc_feature 4, 18, 21, 25, 28, 29, 90, 102, 199, 364, 568, 570, 607,627, 638, 682, 746: n = A,T,C or G
cctnactaaacctttgcnaangccnttnntgctgatcccatcgattcgcaggcctggacttcgcccccaggcctaggaccgcggtgggtnttaaccctgctnctgccccaacagggactccaatcaatcggagttctccccttgccggagctgcccttcacctttggggcccgagacagtcataagggatggacttacntttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcangaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactggttacagctggccagtgcananctgctgctcttttacctttttaggcccctgtaacttnccacctttaaactgcccaanaagcatgcctnttccacaggaagaagggagcagacagggaaatctgcctaccaanaagggtgttgtgtgtctttgtgcccacacgtggtggctggggaatgcctggatggtgccgtggntgatct

SEQ ID NO: 10891 - DNA, 662 bp, Homo sapiens
caagctacttgttctttttgcaggatcccatcgattcgaagaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcc

SEQ ID NO: 10892 - DNA, 253 bp, Homo sapiens
tatgacgtcgcatgcacgcgtacgtaagcttggatcctctagagcggccctactactactaaattcgcggccgcgtcgacccccactgcactctgcctgggcaatagagcgagaaaaaaattttttttaaattaggttttcataattatctttttcatcattatgaaagcaatccttccacaccaagggaaacattgagaaaataccaagttttagaaaggcgaaatgaaaataaatctcctaacttcccatc

SEQ ID NO: 10893 - DNA, 80 bp, Homo sapiens
gctatgacatgattacgaatttaatacgactcactatagggaatttggccctcgaggccaagaattcggcacgaggggga

SEQ ID NO: 10894 - DNA, 62 bp, Homo sapiens
tacgaatttaatacgactcactatagggaatttggccctcgaggccaagaattcggcacgag

SEQ ID NO: 10895 - DNA, 77 bp, Homo sapiens
tgattacgaatttaatacgactcactatagggaatttggccctcgaggccaagaattcggcacgaggggggactgct

SEQ ID NO: 10896 - DNA, 66 bp, Homo sapiens
gaacaaaagctggagctccaccgcggtggcggccgctctagaactagtggatcccccgggctgcag

SEQ ID NO: 10897 - DNA, 525 bp, Homo sapiens
tagggaaagctggtacgcctgcaggtaccggtccggaattcccgggtcgacccacgcgtccggatttcccaagcaatataagtttacaaaataaatgttcttacagaatacaatagttattctgtttgtttgtttcgtttttttgagacagttgagacaggatcttgctctgtcagccacgctagagtgcagtggcaccatgttggctcactgcagcctcaacctcccaggctcaggcgatcctttcacttcagcaacccctactgtcattcccaagtagctgacactacaggtgcataccaccatgcccggctaatttttgtattttttgtagagacggggtttccccatgctgctcagactggtctcaagagatctgactgcctcagcctcccaaagtgctgggattacaggcatgagccaccgcacctggccagaatagttatttgagagtaattcatcagttcaacaaatacttatcaaggagatatagcagttaacgaaatagacacaaatattttccct

SEQ ID NO: 10898 - DNA, 468 bp, Homo sapiens
ccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgctcttcatccaaatctagggggcttcaagagaggggcaggggagattgatgatcaggtgcccctgttctcccttccct

SEQ ID NO: 10899 - DNA, 483 bp, Homo sapiens
  misc_feature 441: n = A,T,C or G
tatgacgtcgcatgcacgcgtacgtaagcttggatcctctagagcggccgcctactactactaaattcgcggccgcgtcgacaccaccagtggtcttaaggttgaagtgtggttcagggccagtgcatattagtggacagcacttagtagctgtggaggaagatgcagagtcagaagatgaagaggaggaggatgtgaaactctcaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcanaaccatcatcaacaccaagatcaaaaggacaagaatccttca

SEQ ID NO: 10900 - DNA, 575 bp, Homo sapiens
acttttgaaatacagaattttatttagggggtgtttaaagtagaaaaaaaccctgtcaagaaagaccaggtggaaaatgggttcccaataaaatggaattttagggcaacaaaagtctaaaaggccacaaaagagaaatagcaccactgtcatttgaacaatggctagttacttgcattttttggcattgttaatcactgaatctgggttttcctctgaattccacacagagcatgcactacacaacatttttatcataaaatacttgctttctacacacatttcaggacaagctaccaccagaaacaaatcaatacaaatacatcaggggctgaacaatctcagtagtgggtgagacacattttgcagaatcctgccaaacaaaggaactgaataggctgtgggcaaagcaaatgagggagagttaaggaatgaagtattttaaatattaataattaattcagacacggtactgtattttccgcaaaagaaaattaacatttagtaacacactaatgaattttatctccaaagagattagtgcactggcaaagtattcggattacagtggagag

SEQ ID NO: 10901 - DNA, 499 bp, Homo sapiens
tatgacgtcgcatgcacgcgtacgtaagcttggatcctctagagcggccgcctactactactactaaattcgcggccgcgtcgacctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagactccgcctc

SEQ ID NO: 10902 - DNA, 614 bp, Homo sapiens
cgactcactataggaaactggtacgcctgcaggtaccggtccggaattcccgggtcgactactactactaaattcgcggccgcgtcgaccaacctcctactcctcattgtacccattctaatcgcaatggcattcctaatgcttaccgaatgaaaaattctaggctatatacaactacgcaaaggccccaacgttgtaggcccctgcgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctagttaacctcaacctaggcctcctatttattctagccacctctagcctagccgtttactcaatcctctgatcagggtgagcatcaaactcaaactacgccctaatcggcgcactgcgagcagtagcccaaacaatctcatatgaagtcaccctagccatcattctactatcaacattactaataagtggctcctttaacctctccacccttatcacaacacaagagcacctctgattactcctgccatcatg

SEQ ID NO: 10903 - DNA, 459 bp, Homo sapiens
ttcactagtaatgcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggc

SEQ ID NO: 10904 - DNA, 495 bp, Homo sapiens
tggtacgcctgcaggtaccggtccggaattcccgggtcgactactactactaaattcgcggccgcgtcgaccctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattaca

SEQ ID NO: 10905 - DNA, 278 bp, Homo sapiens
gctcgacctgctgtctaagagtgctcagtgtccgctgagagtacactatctatcatcacaatatggtgatgagaggtgttttatgtttgtgttaatttcccccactaaatcagtaattattacaatcctgtccctgctgtttaccctgcagctgtttttccatttgtcgagagagcgggtgttctctgaggaccgcacacgtttctatggtgcagaaattgtctctgccttggactatctacattccggaaagattgtgtaccgtgatctcaaggtaa

SEQ ID NO: 10906 - DNA, 678 bp, Homo sapiens
  misc_feature 1, 356: n = A,T,C or G
naacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatctcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttanagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttg

SEQ ID NO: 10907 - DNA, 358 bp, Homo sapiens
  misc_feature 112, 245: n = A,T,C or G
atctcaatacctattgataaaaactagaatttaactgaggacgtgtaaatcagcatatccttttaaaaagttatgcctggccaggcacagtgtctcatgcctgtaatcccancagtttgggaggccagggtgggcggatcatgaggtcaggagattgagaccatcctggccagcatggtgaaaccccgtctctactacatgtacaaaaattagctgggtgtggtggcacgtgtctgtagtcccanctacttgggaggctgaggcaggaaaatcgcttgaacctgaaaggtggaggttgcagtgagccaggatcgccctactgcactccagcctgggcgatagagcgagactccatctc

SEQ ID NO: 10908 - DNA, 827 bp, Homo sapiens
  misc_feature 2, 3, 4, 13, 22, 33, 43, 46, 54, 64, 73, 229, 700, 739, 777,793: n = A,T,C or G
cnnntttttttgntcttttggncgagcggcctncggctgcganagnacgacagnagtacaaagnaaacagganctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaggattggntgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaagggaaaagtacagtttcagggcaagaaaacgaaatttgctagtgatgatgaacatgatgaacatgatgaaaatggtgcactggacctgtgaaagagccagagaagaacngccaagaagacctgcttccaacacagaaacagaaaatgngctgagaccagtagtttagtaaccatttttattctttnaataggtttaacgacntttgttgcgggctttaaagaaaccaataggtcct

SEQ ID NO: 10909 - DNA, 711 bp, Homo sapiens
  misc_feature 1, 22, 682: n = A,T,C or G
nacgacagtagggtagcaaggnaaaataatcatgttaattattaatgtcaaccagcgaatgagaaaaaggtgatatggcaggtccatcacatagataccctcatgatattgtgcaattatttagtagaaaaataaaaatgaaagtgaatggccctaagtagctagcacaaaagaggtagatatttggatgaatgacactttgaaatacgtatattgaaacacaaatcatacacacacacacacacacacacacacgtaatacgtgatcattaatctatgacattgtagtattagggtagtaactctattaagatttaattaaaaaattagtaattcttccaaatctgatattataagtgggctaaaaatgtaatcataatgtattttgaatgtttcacttctaagcacaaatagaaataatctaatgaatttccatgtaaatataatattagttatattgaaataattaagaatgcagaaagaatataaatttagtgaaacattttcccttcccaggaaaatctagctgcataattacattgtagtaaaattttgcttgtcaaaatttatattttacagccaggcgcagtggctcacgcctgtaatcccagcactttgggaggccgaggtgggtggatcacaaggtcaagagattgagacaatcttggccacttggtgaaancccttctctactaaaaatacaaaattagt

SEQ ID NO: 10910 - DNA, 731 bp, Homo sapiens
  misc_feature 3, 4, 14, 15, 27, 32, 43, 61, 62, 63, 66, 73, 75, 79, 88, 89: n = A,T,C or G
ttnnaactggggtnntaaaccttgttntgttncttttggccgnagcggcctacggctgcgnnnagncgacagnangggnaatgccagnntaaaggatttgaatttattttatatgcagcaggaagacattttgattactgacctcagtttcatattttaggtaagtaattctgagtgcacagtagagcgtgtattggaaagaggaaaagagattggaaacaagaagaatatgtaagaaactctggctcttgatgtatgataaggctctttagttgagaatctttcagcatgtaaccttttactatcatgtaatcttttaagccttatcacaaaaagccttcagggcttccttggtaacttcattttgactttgttaaaagaaaaactttagacgaaatcaatttatcagaatttgtttttgtgttaaaggattaatgaatttggcagcacccaaaattagaagtagttcagggagctcttgttttaacagagtaagcggcagacctttgcaggctgaatgtggaagcgaagtaaagaaattacttgattggactgggcatagtggctcatacctgtaatcccatcattttgggaggctgaggtaggtggatcacttgagctcaggagttcaagaccagcctgggcaacatggtgaagctccatctctacaaaaaatgcaaaaattagccaggcatggtggcacatgccagtagtcccagctacttgggagg

SEQ ID NO: 10911 - DNA, 692 bp, Homo sapiens
  misc_feature 1, 14, 24, 689: n = A,T,C or G
nacgacagtagggnaggtctaagnagtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaanaag

SEQ ID NO: 10912 - DNA, 737 bp, Homo sapiens
  misc_feature 651, 711, 718: n = A,T,C or G
acgacagaaagggctctcacccaggatcacttccgaaaccacttggccttcagcccctgcctcggccagaggtttcatttttaactgaatatttaccaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgtctgtttgcaggtgctgtcattcagagtccacaggatggatgaatggatatgaaaatgaacaaacgtgtgacacaacactgcatgatttaccggcaatgactttctgatcaagcctgaacatcccaagacaaccatgctgtgaagaagtcggtgtaccccactggagaaggaaaggctgttcagggaagtgaagatgccccagctgacagtcaccacctgccagacataaaagatggaaattcatttctgctaaagagaaagaaaaaattggaagacagggtgaaggtgaacaggcccattataagaaagaaacaaaatctatattctgtctccaggaaacgagagagagaaagagagagaagaagaagttcaggattctaatgtaccaaagggatctcctttttcttgntttgtctgaaatttcaccaaaaacacagagaacatcttggctattcattgcgatgagtanaaactgnagaatgaagaatgaaaatt

SEQ ID NO: 10913 - DNA, 745 bp, Homo sapiens
  misc_feature 561, 647, 659, 671, 702, 721: n = A,T,C or G
attttcagaaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccataccttgggaggccangtgggcgggctgcttgagcccaggagttcaagaccagcctgggcatatagtgagacctcgtctactaaaataaaattaaacaccancagctggggggngtctttagctgnggggaggacctggagcccggaataaggggcnggagcctgctttgctctgncccagctgggacaacagatctgct

SEQ ID NO: 10914 - DNA, 844 bp, Homo sapiens
  misc_feature 2, 4, 11, 33, 46, 53, 63, 68, 73, 248, 249, 250, 624, 690,711, 725, 752, 761, 800, 822, 824, 825, 827, 829, 831: n = A,T,C or G
antncttgggntacaaaacccctttttttgttncttttggaccgancggcctncggctgcganagtcnacagnagggaattttcagcggggaaatgaaggaaaccaaacttcaggttctgaaactccttttgaatttggctgaaaatccagccatgactagggaactgctcagggcccaagtaccatcttcactgggctccctctttaataagaaggagaacaaagaagttattcttaaacttctggnnntatttgagaacatagatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaataccatattgtatcatcaatgctgatatttaactgagttggtctttangtttaagatggataaatgaatatcactacttggtctgaaacatggttggtgcttttatctcgctgnctaaatggaaatattttgctnttcttctgcttagngcagggaaccattcatcatgagtagcnccctctggnttttcattgattaattgggggcatcataaatggatggtnatgctggaggaaaagagagganannanananaaaaaaccccggc

SEQ ID NO: 10915 - DNA, 778 bp, Homo sapiens
  misc_feature 580, 585, 597, 661, 679, 734, 736, 737, 741, 744, 752, 757: n = A,T,C or G
gggggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatctncaatncaacaaggccgnttttttaatgctgagtaacaggcaccaagcggtactgcgttatatctttcacactggccgcagnctcttctgacatttctcncaacctgcttggacccaggagctctttcctgcctgccatgactttcacccccccncnnaatncancaccttgngatgncaacagactgggcctggcctg

SEQ ID NO: 10916 - DNA, 273 bp, Homo sapiens
cttggccttgtcgctgagcgtgctcatatgctcggaggccttggcgtggtactgggccagtctggagccgccgttctccttgagagcctcaaggcgcgcggacaagcgctggcgcaaatagacgctgtacggggccagatgcgtgcgcaccacgtccacatgggcgcgcgcgcggtcgcgcatctcctcgcccagtgggctcatcttctcttgcaactcgtgcagcttctggcgcgcgccctcttggagctctgcgcgcaaaggctccacctt

SEQ ID NO: 10917 - DNA, 605 bp, Homo sapiens
catagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcatctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattcttcctcttcatttccaggagg

SEQ ID NO: 10918 - DNA, 614 bp, Homo sapiens
  misc_feature 475, 528, 612: n = A,T,C or G
aaaaagaaataaaatgttttactcatttacacaaatacacacactgaagtccaccctgggagctggtaaaacaatttcagtctcagacccgtctgttttccagggtcctccgagcctgggcttcctcaagagcgtggcccaagggcccacagcccagatccggcagccccaccaccttcactgaggaggctccgaagctccgttcccgctgctccttacagacaggggaggcagatatacacaaacgcgcctcggcccagcttggggctggcgggggaggctgtgtcttcaaacctttgcccccagttgggtcagtagaaccaccagtgtcctccccttctacctcccagctccactttggaggctgaggaagcgagaggttttctaggcagatttggagccctggagattgagttcacagtgtatgttctgggggcgctggtgcagtcagcggtccagtctccagcctgcaggntggcacactggggtggacgatgggtggccccgcagtgtacacatttgggtggncccggccctataacccagtgttctcttgattcagtccgaaaagaggagcctgtgtacagctggttgttccctgagcgccgtctncc

SEQ ID NO: 10919 - DNA, 604 bp, Homo sapiens
tcggcacgagggggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatga

SEQ ID NO: 10920 - DNA, 596 bp, Homo sapiens
tgtttcctcatttattataaacacaagttcgcaggtaaatagagggtctaaaaaatacattaaaataaataattgggattctcaaagttcttagggcaaataagttatatacagacaggaaaagcagagcaggcccttctcactgggagggtcccgagggaatgagggtgcaagaactctggggagggaaagctggagaggacacagccagccaggatgccagcctcaggggagccatccagcctccagggctggctgaggcatgcgtgttcgtggctgcacggttgctcctggtttgtagcccagcagacaggacactcctcaggacgcagcctccagatgaatgtactccccatgcagttcttccagcagagctgtgggccagcaagcagcactggaggctgctccgcaggtctggaaggccgagggcttccctgggcagtgcgaggacacagaactgccttggacgaagctccttaaccagggactttgtgccaatcctggcaatggggtccactgtctgggaccaagcccggtcccagaagcagcagagagtcacaagcctggcactttttcctctttttccccggggcttc

SEQ ID NO: 10921 - DNA, 410 bp, Homo sapiens
  misc_feature 1, 167, 332, 340, 350, 385: n = A,T,C or G
nttttttttctgagagatctttattctttattcaggatgtgggatcgatcagcactgccagctgggccttggttctagtggcttgctatggtctcctcaatccagtcgatgaaggcggagactcgagtgaacaccgtgggcttcctcgcgggtgttgcagccaaagnaggaaacaaagctggtcacgccatggacctgccagccaccatcctctgtggggcagttgaggggtcctccagagtcaccgttgcagccggagcggaatgtcccctccagcacacaccatggtcttcttcacggaggaaccccaccagttccacctgggagcagtnttcatagnccaccacggngcagcagggcctcctggagcttgtctgggagttgnccgttgggtatagagacggccccag

SEQ ID NO: 10922 - DNA, 574 bp, Homo sapiens
ctatttaggtgacactataggaacagtttgtacaaaaaacaggctggtaccggtccggaattcccgggatatcgtcgacccacgcgtccgtggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgct

SEQ ID NO: 10923 - DNA, 463 bp, Homo sapiens
  misc_feature 321: n = A,T,C or G
taggtgacactataggaacagtttgtacaaaaaacaggctggtaccggtccggaattcccgggatatcgtcgacccacgcgtccgagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccancactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcg

SEQ ID NO: 10924 - DNA, 566 bp, Homo sapiens
tgacactatagaacaagtttgtacaaaaaacaggctggtaccggtccggaattcccgggatatcgtcgacccacgcgtccggtgagctgttgatgtgagtaaagacctttagaactgttcctggcccacaacaacacacaattgacccatgtaacaaacctgcacatgtgggctgggcgcggtggctcatgcctgtaatcccagcactttgggaggctgaggcaggcggatcacctgaggtcgggagtttgagaccagcctgaccaacatggagaaaccccgtctctactaaaaatacagaattagctgagtgtggtggcgcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaaacaaaaacaacgacaaaaaaacccctgcacatgtactccctgaatctaaaataaaagttgaaaaaaaatatatagaatgtgcctggcacatggcaagtactacata

SEQ ID NO: 10925 - DNA, 605 bp, Homo sapiens
  misc_feature 550: n = A,T,C or G
taaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaattnttaaaaaaatccatctatctaggatatgttgatacaaagtctgcttttgctattc

SEQ ID NO: 10926 - DNA, 137 bp, Homo sapiens
cggcacgaggtgttaccaatctgaagtgggagcggccgcaagcttattccctttagtgagggttaattttagcttggcactggccgtcgttttacaacgtcgtgactgggaaaaccctggcgttacccaacttaatc

SEQ ID NO: 10927 - DNA, 506 bp, Homo sapiens
  misc_feature 186, 200: n = A,T,C or G
tatgacgtcgcatgcacgcgtacgtaagcttggatcctctagagcggccgcctactactactaaattcgcggccgcgtcgacataccgcataacgtcgcaagaccaaagagggggaccttcgggcctcttgccatcagatgtgcccagatgggattagctagtaggtggggtaacggctcacctangcgacgatccctanctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtcgacgcggccgcgaattgagtagtagtcgacccgggaattccggaccggtacctgcaggcgtaccagctttccctatagtgagtcgtattaaagcttggcgtaatcatggtcatagctgtttcctgtgtgaaattgttat

SEQ ID NO: 10928 - DNA, 594 bp, Homo sapiens
tcggcacgagggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaact

SEQ ID NO: 10929 - DNA, 657 bp, Homo sapiens
ggggggtggccggtaaatacatgtaccccagtaataaaactgatgtggagtatgagagtggacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgct

SEQ ID NO: 10930 - DNA, 587 bp, Homo sapiens
tccaccgcggtggcggccgctctagaactagtggatcccccgggctgcaggaattcggcacgagctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgact

SEQ ID NO: 10931 - DNA, 527 bp, Homo sapiens
tccaccgcggtggcggccgctctagaactagtggatcccccgggctgcaggaattcggcacgagggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccatgcagcccctaccgcgttgtggtgccctgagtctggggcccgtgccatccggcaacccccaagcctgccccgctacccaagcagccccgccctcttcccctcaaccccggcccaagccgtcctggccgcccgcctgtcactgcagccgcccctgccctgtgccgtgctgcgctcacctgcctccccaaccagccgatgacctctaagctttcacttgggcagagggagccatttggtggcgctgc

SEQ ID NO: 10932 - DNA, 611 bp, Homo sapiens
  misc_feature 518, 536, 547, 552, 611: n = A,T,C or G
caggggtactgccaggtagcaggctttattgggaagggacaaagcctcaggagctgggtgccccagaggctgctgggtcttgagccacagctgcagccaatgcagcagctcgcgcctccttcttccgtttctgtttttcctccttgaggcgcttgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctctcccgacgcttctgctcttcggccagctgcttcacccgcagcgaactcctgcatggtcgcaggctcgggtaccattcgcgttcttcggcctccagctcccgcagctgctccggcgacggcataacgaaccggggacaacccgaaggcggcgncgtaaacgcgcgaactgntagccgcgtanggttncccagctgcaacgcgggtcagagtctcgggtctggcaacgggtccggctgcggcggggn

SEQ ID NO: 10933 - DNA, 626 bp, Homo sapiens
accatcgtcagtccccgaggctctctgcagtccgcgtgagtcctggccaaggtctggcctcggaagctacgagctacaatcttccttcatcctacccacccacgaagagcgccaccccagctgcagaccaagtgaccagcccagttagaaggggctcggccggatcaaacctcggttctgcctcaaagcatctgctgaagctcttcctcgaccaactgaacttcctcactgagtggttcttactagaaaattataagcccagtctgacagtctctgaaagaatgtcagtgttttactgtaaagccaaagatgggggaagaagcagttttgggggtttcctgatcagcttttattcaagcccttaaatctgtgaatatgcgatgttaatgccaccttacatttgtattagattagcagtatgcaactggctttccaaaccgtggtcctactgatagtaatgtagttgtaaaacgtacataggataatttgcctcctacacagtgtgtaaatagcaaacaacatctctttacttggattttttaaaattccaataaattcaatttattttaatgtaaacaaaagtgataacacgcaaacttcctgcctttgacacaattctatttgta

SEQ ID NO: 10934 - DNA, 739 bp, Homo sapiens
  misc_feature 10, 11, 15, 22, 31, 32, 33, 159, 172, 333, 334, 357, 358,361, 362, 448, 511, 514, 541, 556, 582, 600, 606, 612, 614,624, 633, 643, 647, 655, 659, 672, 694, 698, 715, 719, 722,733: n = A,T,C or G
catatagtgnnggtnttatgcnataaatttnnngttttaacttaaaactatttcttattgtacttgcagaatggatagcttgcttttagtagaagcattaggtcgtatactcagataatctaatagaaggtcagatttgattcctgcataagaaagtanagccaagtgctgnagaaatggagaagaaagcaggggcaaggagcagatggcattaaggaagaatgaagtttttgaaggttgggatggacgaaaaggtgtttctcatggagagggatgctttagcaaaggctcaaacattggggcatatttaggcaagagccaagaacagtttgnngggaacatcagaggaaataggcnnttnntagtaaataatggtaagtaagacttgggagaaagaaggtagatttggggctgaggaactagcctaacactggaactttagtagtanccaagtaagatttgtttcaatgttcagaacttgagggtgataagacctgagccgggtcttaanaangaaaatgtggatggtctaaatctggangtattgaggtggaangaccgaaccaaaaaacaggagctganacaccagtgacagtgcancaccanaactananaaaatatctnagaaagtanggggaataantgangtgtagancctncaggaaaagagcnctaaggggatcaaaactggtcnttangattgggatggtagccnttanccnccaagttgganaccaat

SEQ ID NO: 10935 - DNA, 716 bp, Homo sapiens
  misc_feature 4, 17, 39, 175, 177, 525, 570, 600, 636, 647, 655, 662, 672,675, 677, 679, 681, 685, 699, 703, 710, 714: n = A,T,C or G
aggnagtgtgatggtgncttccaaccatccctgaaaaanaagccaaaaaacttttcccgaaaggagtcttcaccaaagagctcccatctggcaagaaatacctccgctacacaccccagccttaagtctcttggagaagctggtgctgtgagccagaggatgtcagctgccaatngngttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaanagtggcagaacttgaagttcaacttcctctgtaaatatccaagtntaaagcccaggaacttctaaaataacccanatgcgctttaatttttttaatatggtttgatcacanaactttaaaanaacccaangctcttntattctttanacntntngnccanctggggaaaaaacntttnattcttncctnct

SEQ ID NO: 10936 - DNA, 669 bp, Homo sapiens
  misc_feature 5, 34, 653: n = A,T,C or G
acagnaggggttttgttttgttttttgagacggnagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattggctgngtcttctttggttact

SEQ ID NO: 10937 - DNA, 362 bp, Homo sapiens
  misc_feature 1, 8, 351, 352, 354, 355, 356, 357, 358, 360: n = A,T,C or G
ncgacagnagggggacagctgggaattgctgaattagaactgcagaggttcctctacagcaaggtatctggggtatatggtcacacaaaggcagctgtattgagagacattgacctagcttaggagtctaactcataaaagagaaataaaagggggttaattattgtatgattattaatgatagtatcattaatattaacgagctcattaatcatattaatgagcagagcttccttagatatatctgtttataatgaatgatacacatatagctctgatgccatagggggagagtaagaatgaacaaagaaataaaataatttttaaaaaatgatacaggcccacgtgtanngnnnnntncc

SEQ ID NO: 10938 - DNA, 620 bp, Homo sapiens
acatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcggcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggtaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaatta

SEQ ID NO: 10939 - DNA, 596 bp, Homo sapiens
aattacaaattaggatgtaaaatgtgaaataaaggaacaggataaagagcagcaagataacccagaaacttagatactgtaccacagaattcagtgtagggcctccttctcttctgtatccacaaactcatccttagtaaatttcatgtagctttaaatactatgtgtcagacacttccaaacccatttctccagtattgaccttttcctgtaactccagattcaatatccaactagttgttacctccattcggatatttttaagaggcatctcagacttagccaaaataggactcatattttctcataaccctacccttctcctaactcagtatcatgcagttgcgcaaaccacaaatatataagatttttcttgttctctctttccatcccttttttcatccagtgtattagcaagccatgtcaactttatttccaaaacatatatatatattttttttcagacagattcttgcccaggttggagtgcagtggcatgatctcagctcactgcagcctccacctcctgttcaagcaattctcctgcctcagccactaagtaactgggattacaggcacctgccaccacgcctggc

SEQ ID NO: 10940 - DNA, 538 bp, Homo sapiens
aaacttccgccgccgcgtccgccgcctccggaactaaacggggtgaggtcacattcggttatctctaacgttggaaaacgatggagctaacacccattatggagattaaccacttttcatcaggtttttaacttaagtcgtgaggaatacaactgtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatc

SEQ ID NO: 10941 - DNA, 791 bp, Homo sapiens
  misc_feature 2, 10, 11, 13, 16, 20, 21, 25, 32, 43, 45, 52, 72, 74, 77,120, 628, 646, 747, 751, 757: n = A,T,C or G
anatcttggnntncgntaanncttncttgttncttttggccgnancggcctncggctgcgagtgacgacagnanggnagggtaacaatgtaccaggcaaattgtaagttgaaattctagnataagcatgcagatgacttacaatataaatgaagaataggaaacattttatcttcttaccaagtaccttactataagtaaacctaagataagaaaacccagatttacctataagattgttgggagttaatggtgtcaataaaaggattgatggtccctctaatgaaacccagtagatgtttgttgaattgaactgaaaatttatgtggccagacacagtggctcatgcctgtaatctcagcatttggggaggcaaaggtggaagtatccctcgaggccaggagttcatgaccagcctggtcttttgtggagaccctgtctctacaaaaatataaaaatcagccaggcgtcgtgcacacctgtggtatcagctacttgtaaggctgtggcagaggtgctttggcccgggaggttgaggctgcagtgagccatgtccacgccattgcctggcagcctgagtgacaaaatgagaccctatctcaggaacaaaaaggaaaagaaaatatacntgatgggattcctattgngaagtcatttaaaataatgacttgaatttctcagaaatttcaggagctataaactatttaaatcaaaatattcttacctatagaaaccagtagataatganaatntttagnggcatctggcctattttgactttgagtatctagc

SEQ ID NO: 10942 - DNA, 841 bp, Homo sapiens
  misc_feature 2, 3, 5, 14, 15, 16, 21, 23, 27, 34, 45, 47, 54, 65, 68,75, 80, 606, 694, 701, 720, 724, 750, 751, 763, 770, 793,806, 807, 810, 821, 831, 834, 839: n = A,T,C or G
tnnanacttgggtnnnaaaanancttntttgttncttttggccgnancggcctnacggctgcganaancgacagnaaggnattttgacactgagctctggggacaggacaccttgggtttgtggactgcagcccactatgatgttattacttctctggccaggcctccagtggaagtgcacaggcactcccaatgttgttaatgctctgtcttccatttgttccggaatcctacgtgttggtctgtggttccatgcattagctgtttgtaaataatgcattgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaacctgtaagtctgtaacctggcaacattttacaaccctgtatttttaaagatggctttctaataaaaaatccggaaccacacagccctatggtcaaacaatcctacgtttgtgcctctgcttttaaaggtgctgtgctggacagttggcatgccagggttcgagaanagtgaatggcttgacgtacttgcagttaactgtgcaaaattggctggctgcctctgttcctactggactgaactttgatcatgtctgntcctgtncattctcccaggagctttntgcnactgacacccctccccaccccggtannggaatgctgggnctgggancatggatttctgctgactttganggataacatccanntanttagaaagctnctgcggatgnccnttccngg

SEQ ID NO: 10943 - DNA, 171 bp, Homo sapiens
tcggcacgagggctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactc

SEQ ID NO: 10944 - DNA, 501 bp, Homo sapiens
  misc_feature 189, 324, 331: n = A,T,C or G
tcggcacgaggagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcanctgcagctgttatcgtgtatgatattaccaagcaggattcattttataccttgaagaaatgggtcaaggagctgaaagaacatggtccagaaaacattgtaatggccatcgctggaaacaagtgcgacctctcanatattanggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttg

SEQ ID NO: 10945 - DNA, 533 bp, Homo sapiens
tcggcacgaggccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttc

SEQ ID NO: 10946 - DNA, 488 bp, Homo sapiens
tcggcacgagggggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttg

SEQ ID NO: 10947 - DNA, 325 bp, Homo sapiens
tcggcacgaggtgtggtgtaagaatgaattaaaatatagtttcactggcttttctctacatatccactatcacaatggctaggtttcctgttgctcactgttggattctggagaaaaatttaatgaaagatgatatcagaggaagaataagtggaggtagagaagaaaggagtgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacact

SEQ ID NO: 10948 - DNA, 596 bp, Homo sapiens
tcggcacgaggcatgactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatgtgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtt

SEQ ID NO: 10949 - DNA, 614 bp, Homo sapiens
  misc_feature 489: n = A,T,C or G
cggcacgaggcgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcanattgtattgtcaacatgggtcatttaaagtcctgtatgaaccataacctgctgtggtacctttgtacatgtttgattctgtattctttattccagtgtggcatatgtgcccctctgtatcttttg

SEQ ID NO: 10950 - DNA, 636 bp, Homo sapiens
  misc_feature 345, 379, 381, 405, 444, 488, 518, 521, 542, 547, 553, 561,583, 592, 627, 636: n = A,T,C or G
gggggaggaggcaagacaggtgcacagagcatagctttgtcccatctcaggagccctgggttccatcccagctcctgatcccaagagatacgtttcccgggactccaagggagagctgaaacactggtcaagctcagagacctgaagctctttcccactgctttagggacagcatcaaagcagggaagtaggggtggtgagtgtgtaaaatttaaggccaattgcagaggtgggggaaggatattctttctctctctctctctctttctctctctctctcacacacacacacacacacacatacacacatcctgcctcccatttttaaaacaagtcgtttattanggtcaggtgaggtgactcacgcctgtaatcccancncttttgggaggccaaggcaggcanatcaccctgaggtcagggagttcgagaccagagttgccnacacgttgaaaccccgtctctactaaaagtacaaaaattaggcnggcgtggtggtgggcgccctgtattcccanctnctcgggaggctgaggcacaanaatcncttgancctgggangcggaggttgcagtgagctganatcacaccnctgcactacagcctgggcacagagcgagactcctnttaaaaaan

SEQ ID NO: 10951 - DNA, 765 bp, Homo sapiens
  misc_feature 74, 551, 566, 603, 639, 645, 646, 659, 687, 688, 695, 732,735, 736, 737, 740, 744, 751, 753, 756, 759, 761: n = A,T,C or G
cacttttcagcagcaggcgagggggctgaggaaaggaggtgggtctaggcaggggaaattggggtgccaccagnacggagacagcttggactaccaggtactaatttcaagtatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacaganaagctgacggaacanaaggatggatgaagatttaattgtgacccaaagtcanaccaccttcccctgcccattacaaggaggaatgaanaaccanngaaaataagtggnggcccacctatgaaaagaccccttgtcnntgattgntccagcaaacggaaaagaagccattggcctaattggntgnnnccncggnttaaaancnatnttncngaag

SEQ ID NO: 10952 - DNA, 768 bp, Homo sapiens
  misc_feature 12, 19, 28, 29, 37, 87, 92, 118, 234, 517, 518, 570, 586,595, 619, 624, 662, 670, 676, 692, 710, 711, 712, 716, 727,728, 742, 749, 767: n = A,T,C or G
ggatcttttatncctttgnaatcccctnnctttggcnaatcgcccgaattcggcacgagagttggagaacattatgctggagagagnttttnaagaaagggagatgttggaaacttcncaagctgctgctctgtttctgcccaaccgcatggtgcctggacctgactacaattcctacaaaagtgcctacagccccagcccagtggaaccaccaagcaaggacttctgtaattntttgcccacctgccttgatttaaccatgcagtattcagggtctgggaatatggaactaatttcttctaatgtcagcgtggccacaacttatagacagtatcccttgtcctcaagatttttaagtttggcccaagtgtggccccattagcgacaccctcctctaccagcaatgcctgctaaatgccaccacctcagttcaagccctgaagcctggggccagctgggacttgaagggagcacgagtccaggatggactcagtgcatagcaggacatgatgccatnnaaattggaaggttccctggtgctgcctcacacttcctgagatccagaccacnagaaagtgaccttcanggtcatcangctgtcccagagaggtccgcgttnttccnaccccgaccgggaatttctcttcccattgttgacaccngacttccntggcancttcaaaggggcattntcttaaccgaagattcannnaaanctaaacaccanngcacccctttggcnacttaanccattaaatccaattccnc

SEQ ID NO: 10953 - DNA, 265 bp, Homo sapiens
catgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctc

SEQ ID NO: 10954 - DNA, 85 bp, Homo sapiens
taggtgacactataggaacaagtttgtacaaaaaacaggctggtaccggtccggaattcccgggatatcgtcgacccacgcgtcc

SEQ ID NO: 10955 - DNA, 416 bp, Homo sapiens
tttgtagaaatgaggtctatgttgcccaggctgcttgtgaactcctggcctcaagcgatcctcctgcctcaaactcccaaagtgctggaattacaggtatgagccatcatatttggctaattttacctcctttttaaataaagctgactactactacaaaaataagtattttaataaatcagaagtctacgaaatatttgagaacacacattccatcagctgggagcaaaatatgaattattagtagaatcccacctagagtaggaatcctatgctaggtatgttaataaccccatttactaccaccaaaggaaaactgagccaggccagaaagctaaaaatcccatgtgacaatacctcagagacacaagagctcatcatacggaggcataacttagtacaaagtcataattacc

SEQ ID NO: 10956 - DNA, 74 bp, Homo sapiens
tggtacgcctgcaggtaccggtccggtattcccgggtcgacatcatcatcatgatcgctcgacatcgatacgac

SEQ ID NO: 10957 - DNA, 571 bp, Homo sapiens
tttgtacaaaaaacaggctggtaccggtccggaattcccgggatatcgtcgacccacgcgtccgcggacgcgtgggcttggccaggtgtggaccatggtccatgtgtccacatgtccagggagtgcatgcggatgggccagcacacatacagtcatggttcatgtgtatcttgcttgaagacagctgtatagcacaagttctgttttttgccttctgcctttgtttgcagaacaataaaattttctatcagagtagccttgcatcagttacctgggttcctcccaagagcttgagaagttaagcaactttgtgagttgttggcctaaatgggtctatatcccaggccccacttctctttctactgtgtgtttgttgatcaccacagcctgaggcaaaactgagaagatttttaaacttttaactgaaactcgctagacagctttttggaaatatttcctttttagatgaggcctatccctaagtagttgttattagaatatatgaaaacaggattctggagtcttttctttgcctcatattaagcaaattaaaaggaaaacctcacatagc

SEQ ID NO: 10958 - DNA, 490 bp, Homo sapiens
  misc_feature 317, 414: n = A,T,C or G
ctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggnggccgcctggaggcggagctgcggagcatgcaagaagtggtggaaggacttcaagaataagtaccaaagatgaaaataaccgccgcacagctgctgnaattgagtttggtgttgctgaaaaaggaagggggatgctggcctacatgaacaagggtggagctggaggcccaagg

SEQ ID NO: 10959 - DNA, 494 bp, Homo sapiens
cggcacgaggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatata

SEQ ID NO: 10960 - DNA, 536 bp, Homo sapiens
ttaaacatcttctgcatgtttaaatgatgcaaaaaataatttcactccataggcttgaaaacatttcacagacagttcattcctatatctttagacaccatggttgtagcagtgcctccttctgcaaggtaaacagcagtgctggatttggaatgaactgccctgttactgccattattgttgacttcacagtccagcgattcagtggagatgacccaggtggaggggcgccaccgcttaagagaatagggagttttcacacgtttcttgatcttttcacctgatcctgatttgccatcttgtgttgactcacctatctgtatactgctgccatccaggacatttgtggctgaaagatccagagaattaggcctctgtgctcttctgggctttgatggcccaggatctgctgctgtgcttggaacaccctgtgcaagaacatcttgttctgaacatggattgctgttgttgttattggaattagttcggccaccttctagtggccgttccctcctgtccacaagacgatccagaac

SEQ ID NO: 10961 - DNA, 477 bp, Homo sapiens
tcttgatattcccattggcatccaagaggatgttctccagcttgagatctcggtggacaactctgttctgatggcaatagtgcacggcagagacgatctgccggaagaaatgcctagcttcgcgctcactgagctgctgccgctcgctgatgtagtcataaaggtcgccccggctggcatactccatgacgatcacgatcttgctgctgttctcaaacacttcatggatggcaatgatgtgagggtggttgagtgatgacatgatctcaatctccctccgtatgtgcatcagatcttgctcatctttgattttgtccttccggattgacttgatggccaccaggcgccccgagctctcccgcgccttcttcaccttcccgtaggtgcctttgcccagggtctccaggaactcgtagcggtgccgcaggttgtgcttgtggtggtgccgcttcaccgcctgcttcttcattaggggct

SEQ ID NO: 10962 - DNA, 445 bp, Homo sapiens
ccagtcagaatactcctgacagctgtcactgggttggtcccatggcaattctccagcgagcattgcagtaagtactattccacaggaccaaacatcaactggttctgcatgaaattctcttctcttcagaagttctggagcaacatatggtaaagtaccacacatcttgttcaacaaacgctcacgattattataccgaaatactgttgccaagccaaagtctgagattttgaggttatccctttcatccaacagaagattttctggtttaatatccctgtgagttattccaataccatgcagataaaccacccctgccatgagttgatggaagaatctctgagcatctggttcaggcatgcctatgtctggcttctccataggcaccttctccccaggtttgcaccaagtcccagtcttccacaaagggcactgccatgactcc

SEQ ID NO: 10963 - DNA, 583 bp, Homo sapiens
aaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtggacactccagggctctttgacaccaaggagagcctggacaccacctgcaaggaaatcagctgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagca

SEQ ID NO: 10964 - DNA, 413 bp, Homo sapiens
ccatttaaacgtcaccattacttaaaagatgattgattattgctataccaaatcagatgaactctgttcatcacttttcttctctgtccccaaacagtttggttcattacactactgaaatgttcgtgtcttcaacttattagaatggaagataatgcagatatttctgtgggaaataaaataactaattttgaggtaccaaatagtgcaattgggtaaaacagggtttattcagttgcatctgtctccagtgttgcattgacagctctgggtctttttttgggccaccccttttttgacattgcttccagcagtggaaaatgggcatttgatggcaatatgccaaaattattgtgtccagagagtacactttttcaaaatgctcacctactggaagtgtgaattacttgaca

SEQ ID NO: 10965 - DNA, 624 bp, Homo sapiens
cacactacaatagttaattttatttgttcaagagctcagattgcaagcattaaaccaagcataggctttgattctgtgagcccaaattcacatattgaagaagatcaaagcaaactgtgatccatgtacatggatgaaaactaaaggctcgagttaatcacattgtagtttttaaatttctacagcctagagctcactagtcacaggtcttttaggtccttctggatgtcccacagggtatctgcacttttcttgagctgagcaacctcatcatcctttagcttctggttgataacgctggttaatccccgggcattgaggatacatggaaggctcaggaagacttcattctcaatgccatacatcccctttaccattgttgacacgggatgaatcctggatagatttttcaacatggattcaataagatcagccacacttaatccaatagcccagttggtatatccttttagcttgatgacttcataggcactttcaaccaccatcttatgcacttccttccaattttcactatcatttgcagttcccatttctggattcattcctggagagaacacctgcccattacaccatccacacagccacactgagtcgcatgtcccc

SEQ ID NO: 10966 - DNA, 764 bp, Homo sapiens
tttcatttacaagaatgtattcttgtattcatattacaagaaaatagaaatttaaaaattcctaagaaaggatgtggcagttataaattttatatctcacaggcaccttattgtaaccttgtgaatatgccttttcccattcttcctccgttttccttgtagcccatgccaaggatgacctcgggtgctctgtagtagcgagtcactacataaggcgtcatcataaaactcgttcctgcagtcctggccagaccgaagtcaagaatcttcaaagtgcaatcagattttactactatattactgggctttaagtcccgatgaataattccagcagaatgaaggtgcttgattccacacagcatctgatagagaaggtaggacattctttcatgatctagctccatctgaatcacttggcaaagatttgcatccatgagctccatgactatgtaaacatcttgaaattcttctagggatttctgtggtgtgaaaacattcaaaaggccaattatatttttgtgattaacacatttcataagaactagctctctgtaggcccgcttggcatgagtctgattctgaaatggtcggcttagcttcttgattgcaacatttctttcaagaatggatcataagctgcgcatactatcccttgagctcctgagccctataggtttaaaatctgatatcgtttcaggactggtgaatgagaaatctcaatctctacactataaaaaaatggtgtcacgcttgcttctgctcat

SEQ ID NO: 10967 - DNA, 573 bp, Homo sapiens
  misc_feature 518, 570: n = A,T,C or G
gacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcangcgagctagacccggagaggatgggctctggcattcagtacggggatgcgtncct

SEQ ID NO: 10968 - DNA, 373 bp, Homo sapiens
  misc_feature 207, 216, 230, 254, 257, 267, 281, 282, 293, 307, 310, 327,332, 343, 353, 354: n = A,T,C or G
gggattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcaganagcctggangtccaccgccgtanacaggaaggctgaggtcatttgtntcncacaagaaanagttcttcctttcnngaataaattgnctgaaaacgtcttnctntccgagacctgggaacnaagtnaagctaatccntaaaggaggnncacgaaatcaccttttgcc

SEQ ID NO: 10969 - DNA, 105 bp, Homo sapiens
aatttaggtggaattgatgtctgggcaattaaaataaatggcataagagcttaaaaaccaaattgtgccagtggctttcaactagaggcagtaacctgtcattcc

SEQ ID NO: 10970 - DNA, 884 bp, Homo sapiens
  misc_feature 632, 656, 665, 667, 683, 697, 717, 726, 738, 748, 784, 791,800, 803, 804, 808, 819, 823, 841, 853, 857, 858, 860, 868,870, 879: n = A,T,C or G
ccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatattttttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgttgcccatcatttcattcatccttgcctggattgagacgtggttcctggattcaaagtgtacctcagaacanaaaagaaacagactctgtagttangatgcttananaggcagactatactgnggtcttctgatggncagttattcctctgatccancagactganaactgaaaaacngacggaaacnctttaaacttgatctcttttgtaattgaaacctcanaagctcngcaaaagcngcnngatncctgcaagaantaanggcccctgtgcttttacntaaaatttttgntctnnantgcctccncntatctcggngagag

SEQ ID NO: 10971 - DNA, 414 bp, Homo sapiens
  misc_feature 335: n = A,T,C or G
atattttatcagttgatgaatctcaaagtcttgccgtcttaagaaagggctttttcatcgagtgcttgaaatgtaggtttgtgagttgatcagaagcctcaaagcttcaggtgggttgaagttgcaatagataattctttgtattctgactttgaaagcgtttattttcacttcagtgtccaaaattttcacacacagaaaagttgaaaaagtgatagatacatatgcatatatactctttctagattctatgacgttttgctgtatttgttatatttgcctacaaaaatgattatttatttatgtggagacggagtttcgctcttgttgcccangctggagtgcaatgccgcgatctcggcttaccgaaatctccgcctcccgggttcaagcgattctcctgcctcaacctcc

SEQ ID NO: 10972 - DNA, 726 bp, Homo sapiens
  misc_feature 1, 2, 10: n = A,T,C or G
nnacgacagnagggattttctactttagcatgcattcaacctgcttcaattcagaatgcacatcatgactcacttctgcggtctgtgagtttgaatgtcagttttgtttcaaattcagcgttatcttggtctgctctgcctgtgtgctacccagagaccagtggatacccagaaacccgagtggtattccacagcatagctcagttcttaaagcttttgctgtgttaattctgatgagtttcacacataggccacttggggatgtgcacaaattgaaagacgctttttccgcagctccctcctctctgttattctgcccacactctctgtgagggggtaggtgctgcctctgttactgcaggacaggtggtagtcaacagggctctaccctagagtgtccatagcatcccatgggaagaaggaggagggagggggtgtcacctcttatcccattagtgcaggatggggctcattaatagagctccacttgtctccagaatcactggtgaggaaggggagtgttgcccccacattcgtgcacagcagggatggttcaccgaactccacaccagtctctgcagagcctgttggggagaggagggctgtgggttctttgatggtgttcacctggagtagagcaagtattgtcaaaagggtcatcctcggaggttgcagtgagccgagatcgcccattgactgcagcctggagaagagcagactcctctc

SEQ ID NO: 10973 - DNA, 847 bp, Homo sapiens
  misc_feature 1, 718, 724, 764, 786, 787, 789, 791, 795, 797, 798, 802,806, 809, 813, 824, 826, 831, 840: n = A,T,C or G
nacgacagaaggggtgattcccctaagaaagacatatattttaaaaacttaaaaaggagttgattgcttgtatcatatgattgtatatgtatgttagcttataaatgcctacatatacgcacaaccatatatctatattcagctattaaaaatatgaccaaattctagccaggtttacttgcctttgatttcagtcaaatgttttggtcataatgaccataaatgaaatgtagctgactttttatcacactgacaacaccgaaagtttacacaaatatttatgaacagtatttgcaaaaagaaagatgtagttagctgataagtttggtaattatccttcagcaaatatacatattagcttatcaacctaaattctattatgtacagcttcaaaatattaattgctatatatataaaagtttaaaattaagtagaaagaaattaattgatatcttaaaattgagcatatgtttaatgaattcattttattttataaggctgagtacatatacagatgatcccattttagtttctcagctattttactatatgttaaatattttgatgctgtatttacatattagcatcagcaaccataatttttctgataacttttcaagatcagccaaatcatatccttgccagtccacttttctctgagttttcataaaaccaaataaagtatctgcactggtagcatttacaatctcctcattanattatnatgctttagtgagttttcttttaacgcagggtaaggcagnttggttagttgtatttttcccnngnanggcnanngggngacngangganagatgattctncngctgnggacttgtntagaaaa

SEQ ID NO: 10974 - DNA, 129 bp, Homo sapiens
  misc_feature 11, 22, 23, 24, 39, 41, 45, 51, 55, 64, 75, 79, 89, 90, 119,122: n = A,T,C or G
aggggtctctntcgggggggtnnnggccaggcgaccaantnagantgctanccgngcatgatanagattctgctncccntctattcctnntagcataatgaaggtacctcacatctggntcngctgtgg

SEQ ID NO: 10975 - DNA, 63 bp, Homo sapiens; identical to SEQ ID NO: 10673

SEQ ID NO: 10976 - DNA, 314 bp, Homo sapiens
tatgacgtcgcatgcacgcgtacgtaagcttggatcctctagagcggccgcctactactactaaattcgcggccgcgtcgacataaaattcattgattttgatatttttccacgaagtaattcttttcaatttcatcatgatcattggtcacacagcatttcttaaaagacttcaccggcctggcgcggtggctcacgcctgtaatccttgcactgtgggaggccgaggctggtggatcacgaggtcaggagatcaagaccatcctggttaacactgtgaaaccccgtctctactaataatacaaataattagc

SEQ ID NO: 10977 - DNA, 763 bp, Homo sapiens
gaaggaaaggaactttaatgagaaatcaaaacacagggaaccaaagtgcaaatcatccaccccccatgggggggccatcctgaaccccacatcaacccctcagcccccttcaggcccccagcgcaggcccagggcctggagcttctgcctcaggtagctcttgagctggggcaggcctctctgggactccagttcctcgaagggtagcggcaggagctggtagcccatcaggcctaggtgccgctccctcagggccctcgagcccagcagcacccggccgtcccggcagaaatgccagcgttcccgcaacaccagcaccaccctctgggcagggtctcgagtagtggcgctagaggcagcctggccctgtgggcaggaccttggtgggtatgcaggaaggggtcctgggtcctcacgggaagcacagcaccagagctgctggcgcacagcaggaagtctgtgcagtagcctggaggcacagtcaggtcctggcggtatttctcctcccccagcagctggcgcaacccctcagctactatgtccttgtgactgtacttgcagcgggcacggtcggtgatgagaggctggggaaagatgggcacttgctgccttcggggaaggcggggacccccggtatcctgggagctccagctccacggccgtgtccagcagggagaggtacgacgcacaatcagagcattgagggtgcccactgatgagtgatgaagccagggggaaaaacaaagtggcaggctctgaaggg

SEQ ID NO: 10978 - DNA, 91 bp, Homo sapiens
aaccctcactaaaggaacaaaactggagctccaccgcggtggcggccgctctagaactagtggatcccccgggctgcaggaattcggcacg

SEQ ID NO: 10979 - DNA, 176 bp, Homo sapiens
aaaactaggcacatttttttaatgagctacaaactaaattacaaataacgttaatagcaagagcactcaaggacaagggtgacagagacaaatcataaaaaaaaaatgctttttttttagcactgtcattacaaaaccccaaggggcacatggcaacaaatccacccactatgacc

SEQ ID NO: 10980 - DNA, 532 bp, Homo sapiens
  misc_feature 335: n = A,T,C or G
ctatttaggtgacactatagaacaagtttgtacaaaaaagcggctggtaccggtccggaattcccgggatatcgtcgacccacgcgtccggaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctganaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttct

SEQ ID NO: 10981 - DNA, 594 bp, Homo sapiens
gagagcagggccactttattggtatagagactgcagagggaccgggggctttagctgttggcagcgatggggtccttaatccagtccacatagttgtagaccttggtgtagactccaggcctgttcttccaggcacagccatggccccaggagacaactccttggagctgtccgttgcagaccacagggccaccagagtcacgctggcaggaatccttgcctccctcaaggaagcccacacagaacatgctgttggtaatctttccagggtaggaggctttacactcagcctgggtcagcaccggagcatccaggcacttcagctcgtctgggtagtcagcaccaaagctcaaagtgttgccccagccggagatgaggcactcagtgccagcagctggaggggcggtgggcaaagagatggtggacacgcgggcattgatgacggcaggtgaggagagttgatcagcatgatgtcattgtccagagtgtccctggtgtatttagggtgggcggtgatcttggccgcattgatgaactgctcattcccctccaggactttgatgttggctcctcccatctcaactggatgcgggt

SEQ ID NO: 10982 - DNA, 506 bp, Homo sapiens
  misc_feature 350: n = A,T,C or G
ttacctgtttcagtgggttatgtttttattctacgttattggtaggacagggaacagggccaagacctccacactcccctgggaagaacagtcaggagaattagatacatctaaagtgggcacaggacagaggccagatcttcctgggaggtggctgaagagacttaggcttaagccacgggggccaggccgacctggttgtttgccctgtcgaagacggtaaagtactggcggatgaagacatcacccaggatccaaagctctccagattcggtggggaggttcatgccctggaagccactgatgcagctcccctcgctctgcaggatgtaggcactgggtggcacggngtactggactccattgatggtgaagacgatgtcgggcaggctgctgatggctgagcagctgaccaccatgtcggcatctgagttctcgctggctccgatgtcgcttctgatgttggcaatggggctggttgggccggtcagcaaagaggttgcggt

SEQ ID NO: 10983 - DNA, 438 bp, Homo sapiens
  misc_feature 57, 108, 113, 159, 172, 430: n = A,T,C or G
agctttaaaaacttaaaaccactttctaaactgctttttagaaaacttttaaaacanaaaaaaaattcaatttttttttaatttattattttttttctgagacggagntcatntctgtcacccaggctggaggttgtagtgagctgagatcgtgccacntgcatgccagccntgggcgacagagcaagaccctgtcaaaaataataataataataaaggcaattgttctagtgatgttaagtgagcttaatgtatcactgcagatgctgaacttatatgataggtgaaatagaaagggtgaatttaaaacagaactttttatctcattctttctttctgttctttttaataaaaggaaggattacggccaggagatacaaccagcactttctgtggtactcctaattacattgctcctgaaattttaagnggagaagg

SEQ ID NO: 10984 - DNA, 191 bp, Homo sapiens
aaaagggtttttttgaaaaaaaaacattttttttaaaattgaaagggcatttaaaattttgggggtgaaaaaaaaagggccttcttacgggggggttaaggccccaaaaaaaatgggccaatggggggaaaaccccttggattttttgtttaaaaaaaatttccccccactaaaaaagccctgggtttttt

SEQ ID NO: 10985 - DNA, 520 bp, Homo sapiens
tcggcacgaggcgggctcctggttcagtgaattcaagcgtgggaaactgctctcctatgtggacgccgagggcaaccctgtgggtgtggtacagatgaccttcctgcggctgctgagcgcctctgctcaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggac

SEQ ID NO: 10986 - DNA, 152 bp, Homo sapiens
gggtaccgggccccccctcgaggtcgacggtatcgataagcttgatatcgaattcctgcagcccgggggatccactagttctagagcggccgccaccgcggtggagctccagcttttgttccctttagtgagggttaatttcagctttggcg

SEQ ID NO: 10987 - DNA, 334 bp, Homo sapiens
aaggctctgcaggagatggacgacaatcagtatgtggtacaactgaaggctgtgttcccacacgggggaggctttgcgctggcctttgagttcatgctgtctgatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcatgccagctcaagatagcggactttggcctggctcgagtcttttccccagacggcagccggctatacacacaccagg

SEQ ID NO: 10988 - DNA, 157 bp, Homo sapiens
tactaactacaggaagctaactaatcccacgctgtaatgaaccaccttctctggagcctagtccatatttacactgggagaggtgcccgctactgggttactacctcttagctgagtggaagaagaaagcaaagactggaacatctgaaaggaaagc

SEQ ID NO: 10989 - DNA, 568 bp, Homo sapiens
  misc_feature 504, 507: n = A,T,C or G
ggatgcacatttgattttactgggggtaggggacagggctgggcgttcaggagttctccgctatggtgtcctcgatccacttcacataagacagcactctgacggcgacagaaggcttattgggggtgccacaagggacgtagccccatgatgtgacaccttggagcacaccatcacacatcagcgggccccctgaatcacccacacaggtgtctttgccaccttccaggtgtccgacacacagcatgaagtctgtcaccttctggacgtgggcttttttgcactcatcattaggcaggattttgaggtccacacactggagatcatctggaaatgagaaattctctggttcgatgctgccccagccggaagccaaacaggtgctccccacttcgggttcctgggtgggcaactccacgaccttcacagcgtctgtgatggtatcagcaggctctgtcaggcggagcagcatgaggtcgtggctgtagtcctcgtctgcttgcnggntgtgggttctccagagggctcatgtgagcccaggtgtgggaagctctcactgcatgaacaa

SEQ ID NO: 10990 - DNA, 452 bp, Homo sapiens
gtgactgtgaaaaagcaattattcccataattaaaatacaaactataaaaaaacagactcaaagaaaagaaagatgacagagtgaaagaaggtacatttctttcgtgttcaaaccacggagttcacaacacagcagcacacacagctgggcgctttgtggtctcggcaccctcggcttccccttcacggggccgctttcgactagtagaaggctgggctagaacctggggtagagctgtggattcattttcctcagacagaagatcttgaaactttctcttcatgtcttcatcctgaagccacgggtgtcttaaggcttcttctgtcgtaaaacgtgcctttggatccactaccaacaacttcttgacaaggtccagagctttctctgagacttctgcccagacttcaggaatgaagttgtattttccactggtgatctgatccttcagtga

SEQ ID NO: 10991 - DNA, 520 bp, Homo sapiens
  misc_feature 65: n = A,T,C or G
attcaacattaatgaaagatttcagaagaaatacgtataccaactgcagccttatcaagtatatnggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagcta

SEQ ID NO: 10992 - DNA, 477 bp, Homo sapiens
agtggatcccccgggctgcaggaattcggcacgaggcagcttctgagaccagggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacga

SEQ ID NO: 10993 - DNA, 474 bp, Homo sapiens
  misc_feature 273: n = A,T,C or G
ggcccatctgtagaaattgaggctaacctcatctccacactcatcttgtatcccctttgaggagaactgggacattcacctggattcctctagccaacaaaagttctggaacataacacttaccatggggtccaggggggggaacccctggtgggactgccccaggctggggggctccagctggttgctgctgctgtggccctgcagttgaccctgcctgcccaatctgttcagaaaggcccaaacttcctggaggggccccactgccagcangagcagggactacagaagctggagccacagccaagccatggactgcgggtggcccaccagcccctgttggggggataggctgggagcctgggggcagggctggtggtggctgctgctgctgttggtgcatctgttggaagtgctgctgccgagccctcatctccgcatacttcagctgctccatgtggaaagcttgtctgt

SEQ ID NO: 10994 - DNA, 601 bp, Homo sapiens
  misc_feature 427, 448, 503, 509, 559, 570, 580, 597: n = A,T,C or G
aacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtagttccaggaaactcgtggaactttggggctcactgcagaaatcatgtgactgtcacgtgctggaaaataaagtgatacatcttgaaaatgaatccgtgtgttggattcngaagaaatgatattatattcnctataggggacagaaatgagaagcctcacccttttggatcattaggtccctgtanccttgntttagaaccagtttcataaagttgcctccctgggcaccggttatcattcngaacgggtgcnccttgatgcntggtggcttgttatccnaggt

SEQ ID NO: 10995 - DNA, 463 bp, Homo sapiens
tccaccgcggtggcggccgctctaaaactagtggatcccccgggctgcaggaattcggcacgagattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatt

SEQ ID NO: 10996 - DNA, 50 bp, Homo sapiens
tccaccgcggtggcggccgctctagaactagtggatcccccgggctgcag

SEQ ID NO: 10997 - DNA, 805 bp, Homo sapiens
  misc_feature 317, 438, 527, 553, 613, 624, 626, 667, 674, 676, 683, 704,716, 722, 732, 735, 746, 775, 797, 798, 800: n = A,T,C or G
tatgtgtaaggttggacacattttccaggcaaaaacctgagaaggtctctaagctctcacctcacatttagtctctgtccgagcacgaatggaaggtgtgttaggccagtctcgcattgctaaaaagaaatacctacgactaggtaatttataaagaaaagcagtttaattggttcatcgttcttcaggctgtacaggaaacatgatactggcatttgtcaagtttctagggaggccttaggaaacttacaatcatggtggaaggcgaagggggagctggcatgtcacatgtccagagcaagagcaagagagatcanggaggtgccacacacttttaaacaaccagatctcataagaactcactatcacgaggacagcaccaagaaggatggtgctaaactattcatgagaaatccacccccatgatccactcacttnccaccaggccacacctccaacactgggggttacatttcaacatgagatttgggtgggggtacagatccaaactatatcagaaggctaangcagtgttgcagactgcctgcctganggtagaagacatgccccacatgcacacacagcccgtaggcaaacacttaataaacttaangcattatagtntntccagtactagctgaccactagataccagacagacctttgnggccacncncaagganctaggaaagacttgaccactnttggcaaaattnctaacngatgaatggnccncttttaaaaanaaattttcaaactagtcagaaaataaatntgaagtctgacaggatgaactnngntttaa

SEQ ID NO: 10998 - DNA, 854 bp, Homo sapiens
  misc_feature 2, 3, 9, 10, 30, 49, 56, 70, 78, 90, 100, 103, 112, 657,753, 808, 813, 827, 852: n = A,T,C or G
anntcttgnncgtacaaaaccccccttgtnttgtgtgcttttggccgancggcctncggctgcgagtagnacgacagnaggggtctgtgnatttattggnagnatttggagnattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcctgtcccaattttaaagagaaatgggaatgagtttgccctggtgagacccataccattgcaatgattatcttgagcacttaaagtccagtgttggctgntagtgtatttgatattctgcctgtctcctcatgggtgaaatatgtctgaagaatagcagcataatctcttggctgttatactttttaacttcctgngtggaatattgatactttggggattcagcttgtacctcttgctctgtagggattnttggnttacacatggccangattttttagtttccatggaaggtntg

SEQ ID NO: 10999 - DNA, 159 bp, Homo sapiens
  misc_feature 6, 12, 26, 30, 43, 44, 45, 61, 62, 70, 72, 85, 100, 113,117, 118, 123, 147, 153: n = A,T,C or G
actacngaaagntctgggtgcaagantacnacagaaaggtacnnntgcttgactactactnnacggttcngntgtgatgacaacnactgaatgatgcggntttccacaatacnactnnaagtnacggatgcgatatgactaccctanggctgntgttcc

SEQ ID NO: 11000 - DNA, 814 bp, Homo sapiens
  misc_feature 2, 8, 14, 17, 20, 21, 32, 43, 45, 52, 62, 65, 72, 508, 569,592, 594, 642, 655, 659, 680, 700, 710, 723, 728, 739, 747,750, 752, 762, 765, 789, 793, 797, 798, 801, 808, 813: n = A,T,C or G
tnttttgncctacnatnccnncttgcttgttncttttggccgnancggcctncggctgcganagncgacagnaggggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctanatttgttttattaggttcagagtatgtggggaattatataatccctctttcatcactttgngtatgtcttttgttaacatattngntatgccttattctaaaattgagtctcaactggaatgcctttgaagacngatgcttctatanaggntctttgacctaaatagttcancatttgtatttttatctggnatctaatcanatcctaatcatancccgnagaaggaatgnactttaangtngncttgctctgngcncgggccccattttttttcttaaancaancctnnggnaattttnatttng

SEQ ID NO: 11001 - DNA, 628 bp, Homo sapiens
  misc_feature 2, 5, 13, 25, 33, 43, 47, 53, 59, 70, 78, 100, 101, 103,108, 109, 122, 143, 155, 159, 163, 170, 173, 197, 199, 239,292, 323, 431, 448, 461, 483, 532, 534, 538, 545, 552, 566,575, 582, 593, 600, 609, 613, 616, 617, 620, 622, 623: n = A,T,C or G
cntgntgactgcncggtctttggtnccacactncgacttatgngctntgactnctcacnacacaacgtcngggtcttnagtgcctgaagccaacgaaacnncncgccnnccaggaaaaaacnaacaagctccagacacgccancttaacagctgngacnctcnccacganggnccgcggcttcattcttgaagtcantnagaccgagaacccaccaattccggacacactgggattacngggccttggaagaaattttgtacctgtttgcctctgctggatgaagcactctnaacacagctacctaaaagtggaaggaaggangccgggcaaggtggctcacgcccataatcccaacaccttgggagactgagtcatgtggatcactagagctcaggagtttgagaccagcctaagcaacatggcgaaatnctgtctctacaaaaaanatttaaaacttangcatggtggcacgtgcctgtantcccagctactcaggagtctgaggtgggaggattgcttgagcctaggangnggangctgcantgagccnaatcacatcactgnctccacctnagcaccnacagacccatntaaaaanaaaaaaaanaaanccnnggngnnttttt

SEQ ID NO: 11002 - DNA, 244 bp, Homo sapiens
aatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggaggaaagggaag

SEQ ID NO: 11003 - DNA, 444 bp, Homo sapiens
ttaaacccccaagttgccattttagttcaaggggaggtccacaagcactctcccaaaccagtgtttcaaaccttttatgaggagctaaatctgccagcaccagaacttctgaaaaagataaaaaatttgtttctccaattagcagaaaatgtagctcattcccttaatgttacttcttgttatatatgcgggggaaccactatcagagaccgatggccttgggaagcctgagagttggtgcccactgatccagctcctgatataatgggggcttgtccaggatctcatcaggactggatggctctcgctggactatactggatatgtgggcagagagcctacattcagctacctaatgaatgggcagacagttgtgttattggcactattaagccatcctttttcttattaccgataaaaactactggtactatctgtaaattc

SEQ ID NO: 11004 - DNA, 199 bp, Homo sapiens
tcagagaccgatggccttgggaagcctgagagttggtgcccactgatccagctcctgatataatgggggcttgtccaggatctcatcaggactggatggctctcgctggactatactggatatgtgggcagagagcctacattcagctacctaatgaatgggcagacagttgtgttattggcactattaagccatcctt

SEQ ID NO: 11005 - DNA, 633 bp, Homo sapiens
  misc_feature 1, 8, 21, 41, 626, 629: n = A,T,C or G
nagacagnagggggggcaggnacgccggcccccagcccggnagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagatgcaaaacatctgtttatcatagacatcaacatgacctataggttnaanaaaa

SEQ ID NO: 11006 - DNA, 762 bp, Homo sapiens
  misc_feature 1, 2, 9, 14, 566, 669, 710, 740, 760: n = A,T,C or G
nncgacagnagggncttaaattttctgggtcctcttttttttcaactggtagagttaggggactgagctggatgaaagacagtcagatctagttaaaaccctttcaccgcctcttgccaactcaatggacttgagcgagtcactgaacttttccaagcctggtctcttcctctgttaaataacagttccaagagtacccacctcataagattgctaagacactgaaataataccacgcttataaaatgctaggcacaattgcttgaaaatataatattataaaaactttgtgattggtttaaatgtatagagctgaaaatgttctttcatttctaaaatgtcataagtattattttttaaatggataatagggtttatagtaggattatgtatagttctactttttaaaactttccaaacttttattactgtaacttagacctataatataatcaattcataagtaacataatgtataatagtaactttttaaattaatgcaggcaattaaaaataaaatacaatcaccatccttttcagatggttaatatcttgtttgctggaangttttgctggagattatgaattctttctagtacctgtatttctgtgtccaaaaaatttacacttgtatgatttagtaatatgatgtgatagcaaaatcttatnaagctgagggtttttaattgattactattgaaacttatggncgggtgcgggggctcgtacctgtatcccanactttgggagctgagggggngg

SEQ ID NO: 11007 - DNA, 663 bp, Homo sapiens
tgcacatcaatcgcctcattggaaagaagacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgca

SEQ ID NO: 11008 - DNA, 538 bp, Homo sapiens
attcggcacgagggtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctacc

SEQ ID NO: 11009 - DNA, 538 bp, Homo sapiens
  misc_feature 455: n = A,T,C or G
ctggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggngaggcccctgcaggcctgcagtgcccggaggcctgagcatggctgtgtggaaagcgtgggtggcaggcatgtggctctccttg

SEQ ID NO: 11010 - DNA, 530 bp, Homo sapiens
cggcacgagcgaggacgtgttgcaccctgaagagcctcatcatcgcctgctcttgaggttcacagatgatacctttgatccagaacttgcagcaacaatagatccatcttcggttgtgaatccggcccggaatgcagccaccccttatagcaaccccccttgctgctcgtgccctgctgtgctactgcctcagtcacttcctgcttggtcaagaccacagctgctgatgtcacagctgaggcacatcaaaaaggctgcctgattcaaagaaagctgccggataaatcatagagcacagacacttctacctcatgctcttatgggactttaggaaccaaacataagcacctatggaaaatgcacggcggtcttgaaaggctgtggtctttatcagaaaatatctgaatgactgtttgttatgtcagtcctactctgcaggcttgctaagatgatgattgaaagggctcttggtttctgctttggaatctggcatttatgttttgaagcgttgagagcaagcgatgtggcag

SEQ ID NO: 11011 - DNA, 396 bp, Homo sapiens
ggacgtcttcctcatctgcttctcccttgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagccctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcct

SEQ ID NO: 11012 - DNA, 664 bp, Homo sapiens
caagctacttgttctttttgcaggatcccatcgattcgacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttcta

SEQ ID NO: 11013 - DNA, 518 bp, Homo sapiens
ctatgacatgattacgaatttaatacgactcactatagggaatttggccctcgaggccaagaattcggcacgaggctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgc

SEQ ID NO: 11014 - DNA, 608 bp, Homo sapiens
tacgaatttaatacgactcactatagggaatttggccctcgaggccaagaattcggcacgaggtttctccatctataaaataaggtgataattacagctactaaggtagttgtgagattagttaatccaggcatagtactggcatatcatttttgtcctatggcaggtcctcatagcacacgattgctctcagataatgtcatttgtaaaaaggaagcatgtacagtagaaacggtccaatcctggtgctggatgctttcataggagtatgtatgaacacactctgggtgggtggccatactcccactttaccaatgaagaaatgggcctagatgttagatatggccccacatccagtaaggggcagtgctgggatttatagcctgtactcagctctctcccagctgtttacatttgggggcctctggagttataatgaggcctgaaagttagcaaaacctccaaagatcaaaccagagtgccgctcatgctgatgtgatgtgctttctcttacagagaggcggatttggtcgtggacgtggtcagccacctcagtaaaattggagaggattcttttgcattgaataaacttacagccaaaaaacctt

SEQ ID NO: 11015 - DNA, 657 bp, Homo sapiens
tcgaattaaccctcactaaagggaacaaaagctggagctccaccgcggtggcggccgctctagaactagtggatcccccgggctgcaggaattcggcacgagcaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctaaaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttggtatggtttttctgtataacagccttttccttctggttctaactgctgttaaaattaatatatcattatctttgct

SEQ ID NO: 11016 - DNA, 126 bp, Homo sapiens
gattacgaatttaatacgactcactatagggaatttggccctcgaggccaagaattcggcacgaggcccgatacttgcgttgacattgtgattcgacatgtggcacccattcccaaccactatgat

SEQ ID NO: 11017 - DNA, 369 bp, Homo sapiens
ccagagtccatgaggcattttatttgtaaatatatgtattacatccctagaaaaagaatcccaggattttccctcctgggggttttcgtcttgcttcttcatggcccatgatgccagctgaggttgtcagtccaatgaaactatggaggggaaaaagaaagggctggtaagtttaatagttcaacatagggccttctagggcaaaaaaacatcaacactcatcaggggttaagggcgctttcctgtggggcacataggaactgacagtgcctacatgagctggtgcctcatgtagcgtatgagccatgactcctgcaacccaaagagccaaatccagagagcccagccacacaatcacacagccctgac

SEQ ID NO: 11018 - DNA, 391 bp, Homo sapiens
tttatttttttgcagaggaatgaaattaagagatttaaagacaaaaacacaggctggtagtcaaagtaaaggtttatccttgcatcagaatggtttaaatcttgcaatttgcatatacaaagagttcagcaacattcactggcattataatcagagcaagatcaaattataaatgtaatcaaagaaaatatgatagttgaaactgtaataacatacatacattataaagactgcacataaattaaacacaacttagttaaacaaacaaacaaaaaagtatcagtaattatacacttaaaagaataacatggggatgtctccaaatgctgaaacacaggtgtcaggctcatttaaaaaagtgtttaaaaacacataaaaataccttttaaaa

SEQ ID NO: 11019 - DNA, 566 bp, Homo sapiens
  misc_feature 470: n = A,T,C or G
gcccagccaagtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaaattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggngcagcagcagccctgccccacacctcctctcactccccagcctgggcccatctccctgctttggtcttgccccatcactgcgccactgctccgtgg

SEQ ID NO: 11020 - DNA, 401 bp, Homo sapiens
  misc_feature 362, 368, 385, 399: n = A,T,C or G
ccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactacttccgtgagccagatcttcgcttngaacangtctttctgagctttgnccaactgcagccgncc

SEQ ID NO: 11021 - DNA, 455 bp, Homo sapiens
tatgacgtcgcatgcacgcgtacgtaagcttggatcctctagagcggccgcctactactactaaattcgcggccgcgtcgactgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatc

SEQ ID NO: 11022 - DNA, 534 bp, Homo sapiens
caggttgtaaaaaaggcttatttattgagagcagcgagtgtaaaaacaaaaacaaaaacaaaaaaacaaaacaaacaaaaaacgacaacaataaaagtgtggggtaaggatggcccaccctcctcatctccagggcccacccatacctcccatgcccacccaccccacgctgcaattacatataaaagccgcccgtggtgcatacaaaaagggcggtttatatagtgtcaaaagctcctgaaaacctccttcatctgccaggcacttaggatgaggaaaggagagaagggtggggaagacgtgggtctgggtcagtgtgcacaagcccagagtggggaggactcacttgctgtgtcctctataatcctggtctagacccccaagtgggaccagtgggccaagagactcattaaccctgtgtgcccagaacttgagaatattaaggaactccccacaaacccagctcatcccaagcctagccctccccaggcaaagttggcagatgagtggcagagttggacccggtcaagggga

SEQ ID NO: 11023 - DNA, 276 bp, Homo sapiens
gctcgacctgctgtctaagagtgctcagtgtccactgagagtacactatctatcatcacaatatggtgatgagaggtgttttatgtttgtgttaatttcccccactaaatcagtaattattacaatcctgtccctgctgtttaccctgcagctgtttttccatttgtcgagagagcgggtgttctctgaggaccgcacacgtttctatggtgcagaaattgtctctgccttggactatctacattccggaaagattgtgtaccgtgatctcaaggt

SEQ ID NO: 11024 - DNA, 591 bp, Homo sapiens
cctgggccagaaccacagcaggcccggtgaccacagggatacttgtcttggtgtgctcccctagccagcagctggagaaccccctggcctgtgggaacgtagtcagggaacccatgtcacagacagaagggcattgggaggaaatggaaaagcgattagagtccagttatactgcgattgttttcatgggaaccactaggtgtgccagcaccaggcccagagtgagctccccatctactgctggaccagcagggcacgttctctccaggcttcacccactggggagcctttgtacattgcaaagtggaaccaagtcatgggatgaacagggtggcccagagttagcattcccagaggcctggccacagagagctgtcctgtgagagagcaagggggcagcgagtatgtgacatgttggcctgctgcttcctctgcagagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcggg

SEQ ID NO: 11025 - DNA, 706 bp, Homo sapiens
  misc_feature 632: n = A,T,C or G
aaatttttgggaatttattgatttgcatttaaaagggaactgctgacaaagattcactggtaataatttgaacaagttggaaaatacagtcaacattactgaaacactactaaaataattccaggacagaacaaaacttcttagatgctgtctttgatgtgaaaattgactgcttcttacttttctaacacacgggggtataattaacaatattcaatcacttctattctttcctgcatatataaaaattaaaataccaattaaaaaactaatatatcttctctttatttcttacagatatgagttcaatgtttcactcaatagtgctgtggtttaagagaattttttcatttacaagttaaacaacaatccgcccaaagggaactgatagtctataggctcatagtgcaaataaacagtttaggaatgcagcaactgacatttctaaagtacaaaacagataaaattcttagaagatacatgcaaaaagctctactaagcagatggccacagaactagaacattgataattttactggcgatgtcaataggactccagatgtttccaaactcaacttgaactctcatcttaggctttgtattttgcttgtgcagtttcactaatgacacanacatgattcacatgcctggagtattcattatagtcaagggcatatcctacaacacacttgtctggaattcaaat

SEQ ID NO: 11026 - DNA, 749 bp, Homo sapiens
  misc_feature 416, 455, 531, 578, 593, 680, 740, 743, 744: n = A,T,C or G
gcggccgccgtggcacctgcgcgagctagcccactgtaggagtcgggaggccgagacaggtcagggagggtgcctggctggctggggagggccgcgtggttgtgcatgaggctggtgctgcctgcgaggccgtcctcggggtggctgcctccaaccaggcctgcgtgccgcccgcccagcgacatggggccggtgaaacctgaggccagcgccccgtggccaggcagcagcgtgtgcatgtcgccggctgtgcccacggcgtggctgcggagcacgtggatggcctcgtccaggtggtcttctatcttactctgcaggccgtggagacccccgtcgtagctgggcgataaggcaccgggggctcctgctcgaggccactgtgacgttcctgccaggccctggggggagcccacggnggtagaagggctggacgagaagttattgcttgagtgatnccgggagtagatcgaggccagtgctttgccgagggcatccccggagctgccagctgtggtccctcgggagcccagngagctgtcggccccgctgaccaggcgggtgtggctggagacgccgcncgacgtggctccggnggctgaggagaaggaggatgcagatgggagcccaccgttcacctcttgctccatgcagctgtagcccataacgctcgtgctgtgcangccacccaacgtgctgctgcttccactgctgcccaccggccactaccccgggcgagggcnagnngggat

SEQ ID NO: 11027 - DNA, 494 bp, Homo sapiens
  misc_feature 472: n = A,T,C or G
gggccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaactccagggcaaggctaagaggcactgagccctcaacccaagccaggctgacctcatctgctttgctttggcatgtgagccttgcctaagggggcatatctgggtccctagaagtccctanatgtggggcttctagattaccc

SEQ ID NO: 11028 - DNA, 682 bp, Homo sapiens
  misc_feature (1)...(682): n = A,T,C or G
gntgntattantnnnacagatngnttcngctgtcgagtaagactacaagaagggtacaggctgcgacaagacacacngatnngtcccntntgcgtcctgacnntttaagggnaccggctgcgacaagacgtcgagtcggtacngtgtgcacacanagctcaccaacatgtncagntnccatctctcctcanaatgtgtacagtntgccagacgtgctggaacgcncctgttgncncaactcctcagaaggctcaggctggaaaatcacnttgaaccngnncggctgaggttncactnnnctgagnttgcgcnnctncactacaacctngtgacacgagctnngactntgtctcagaaaggtacngctgcnacccccncgncgganggnttctgctgcganangaccnnngaagggtnctgttgcgatntgaccacacccgttcnnggnttncnanaanaccacagaagggtccngctgcganaagacacagaangggtntttattttttcttntgaaatatctgacccntaataagtcttaagtanattagttaaggccaggcccggngtctanacctgtattctgccctttcggngccgnggcngcnnatctnagtcngaaattgagacnttctcncncntgtgaaccccgctctctaaatttnantancngctgctgccc

SEQ ID NO: 11029 - DNA, 763 bp, Homo sapiens
  misc_feature 2, 3, 12, 15, 27, 28, 43, 59, 61, 64, 79, 120, 746: n = A,T,C or G
annaactggggncgntaaaacttgctnngttgttttggccgancggcctacggctgcgngnagnacgacagtaaggagnggctcactaaacattctactactcactctcactgcccaagnaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaagcagacctaaaatcgctcattgcatactcttcaatcagccacatagccctcgtagtaacagccattcccatccaaaccccctgaagcttcaccggcgcagtcattctcataatcgcccacgggcttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctnctacttacaggactcaa

SEQ ID NO: 11030 - DNA, 650 bp, Homo sapiens
  misc_feature 5, 23, 644: n = A,T,C or G
aaagnaatagtttgggacaaagnaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcgctggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctgaggtcaggagttcgagaccagcctggctaacatggtgaaaccccatttctactaaaaatacaaatattagctgggcatggtggtgcacgcctgtaatcccagctactcaggaggctgaggcaggagaatcacttaaacctgggaggnggaggc

SEQ ID NO: 11031 - DNA, 750 bp, Homo sapiens
  misc_feature 2, 556, 696, 738: n = A,T,C or G
angacagaaggggaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaanggggagccggccctgtcatgcgcaggttttccactcatctgaggaagagccagggctctgaatttagcctaacactcatcttggctgtgggcttgggaagaatggccattatttacagattgtatttggacatattgggngatacttgaaagaaaaaggactgccgccctactgaatctgancttttatcctac

SEQ ID NO: 11032 - DNA, 743 bp, Homo sapiens
  misc_feature 2, 8, 23, 180, 181, 373, 535, 541, 580, 603, 625, 631, 640,650, 660, 695, 701, 722, 735: n = A,T,C or G
tngacagnaggggtctctgtggnttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttattnnatatttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattangtggcttgactaatgttttttctataattgtatatggactgcatttttaaaaaaaccgcatttgcctttatactagattgtaaaaaattatattagaatgcataagacatgtttttccttcatatgctagacttttcctagcatttcgtatttctgtgttgncagtgngtgatttttaaaccggaatttgggttaaaaaaatctggngggatatatgtgagaaaactttnggggttaccttatgaaataaangattgnaagtaaagnttcctgcgcncttataccanattcagtataatacactacttttctgtttcaacanaaaatntaaatagccggatatctgaanactggctggaacncttctgaa

SEQ ID NO: 11033 - DNA, 721 bp, Homo sapiens
  misc_feature (1)...(721): n = A,T,C or G
gggagagtcaggcanggttaaactgcnggancagnttgccncccctgtccagatcattggctgctttgcctctaccagttggcatacagccgattgntctacatggctttnataattgtttgaggggangagatggnaacantgtggagnctccctctgattgntnntggggaaatgngnnnaagagtgccctnctttgcatacatnntcctggcannaatgcnacagaatgaattttncacgcntttctttccntggncataggtnagctgnnccttcatctgtngcanatgaaatgttntgntcacnctgcattacatgtggncnttcatncnccanagttgctcagctcctacctctgggccagggcatncatttnnatntnccttatcacattccctntctnagcacancctggggaggggntnattgtnctcctnggcancntnnatctnagagnctcancngactgcganctgcttnccntgncaccatgangcngnngacnattgcagnttcatntgnctngtgacncnatnctcnaagctctcnccactannccacacnaancttggagccgcctgangagctccccngganaaggagaaggnattntgctntacnggatacacatctggagtaagnncaaactaaattcacatccctntaaantaaactactgtacnacttcagngtntcacntgnnggcaccngacataaa

SEQ ID NO: 11034 - DNA, 384 bp, Homo sapiens
agtcttggacctctcaggctaaacagcaacagaacaaagtttagaaaatgatggatactatgtctaatgtgaatattaacaaaataagcatgaaataccaagattgttgttttactctgttatcgtcatcattaattacagtgttttgagagtaagaattctccaattactttagaaaggtattaaagttctgatgttgctttcttaactgttttttagacagggtctcactctgtcaccaggctggcctccaatagaacaatcactgttcactgcagcctccacttcccaggctcaggtgattatctcatctcagcctcccaagtagctgggactacaggcatgtgccatcatgccctactaattttttctttttttttttga

SEQ ID NO: 11035 - DNA, 560 bp, Homo sapiens
ggcggctgggcctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatgtcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgagctgtggaggttc

SEQ ID NO: 11036 - DNA, 582 bp, Homo sapiens
aagtttaacatgtacttttattaacaacttaatacaagactgtacactgtaggtgctgaaatcaacccactcctgaaaactgaaaaaccagcatttctataccactttgggctttggttataagtgccatcttctacagcaaaatcacgtcttaagaacaggaaaaacgttccacgggaatggagagattatctatgcataaacagctggggatcatttctagctttacgtgattcactacacgctctggaatgttcagttcccttttctacagtcctaccacgagacatacagcaactaagaacttggccacaggtcctgcctagacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaaagtcttttacatctgtgttagctggagtgaaaacttgaagactcagactcagtggaaacagatgaatgtccacctcgctt

SEQ ID NO: 11037 - DNA, 505 bp, Homo sapiens
tccaccgcggtggcggccgctctagaactagtggatcccccgggctgcaggaattcggcacgagcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 11038 - DNA, 568 bp, Homo sapiens
tccaccgcggtggcggccgctctagaactagtggatcccccgggctgcaggaattcggcacgaggggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccacatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtct

SEQ ID NO: 11039 - DNA, 512 bp, Homo sapiens
cagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatg

SEQ ID NO: 11040 - DNA, 763 bp, Homo sapiens
  misc_feature 445, 604, 622, 677, 683: n = A,T,C or G
cagagcaaactttaggttttttattaggcttttgacagtactttctgagtatttgagcaattgatgggtttctctctgataccatcttgccacggggccaaacagcacatatgcattttaaaaatgtaattcaagctctaaggagtatgagtttgtattcagaatgcaatttaaaatctacctacctatctacctctctatacgtatatacagggactactttgaacagatccacataaaggagttggagtggagaacagtttcacaataaataatcgcttctctaaactgtacaaaatcctaccagcaaatcagccactttcatttcctcatgataggtcatcacttttatacctgtaataacttatgaaatacacacagaggatttaacatttggtcaaggccaatgctctgtcatacaccatcttaaatgtctctctacggngccctggacacccactcaaatgccgtttcctatctctctgtgactgggttggggagatgggcagccctcccctgcgcaggcgactttacatggtgggataacatctccacactcacagtaagctcggctcggggggaagagccgcagctgaaaagattntgaactgtcagacgggantaggtgttgcaatttatataaaccagaaatttaccataatttacaaagaaaatgnggtcgngacttattttggagccattcccccaaggaccacatttacctatgaaagcaaatattcaacctataacccctgagctcggg

SEQ ID NO: 11041 - DNA, 51 bp, Homo sapiens
ttctactaccataaaaactatcttacatcacctgaacatcaagtgatatta

SEQ ID NO: 11042 - DNA, 497 bp, Homo sapiens
  misc_feature 440: n = A,T,C or G
gattacgaatttaatacgactcactatagggaatttggccctcgaggccaagaattcggcacgaggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccanggcttcactgaattcacaattgaggatttccacaacacgttcatggacctgattgag

SEQ ID NO: 11043 - DNA, 598 bp, Homo sapiens
tcggcacgaggctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaacttta

SEQ ID NO: 11044 - DNA, 656 bp, Homo sapiens
accgcacaaggagaccaaggagtactactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacaca

SEQ ID NO: 11045 - DNA, 378 bp, Homo sapiens
cttcttattctttgacattttgtcagctggtttaggctggggagcagtactgactgcagatccggaaggcggaggagctccagatcgctgccattctgttgcttctgcagccagcctccgaatgtactgctcattcactgacaataagatgttctctggtttaatgtcagtgtggatgatacggcacttggtatgtaaataatcaagaccctgtaacacttgctgaataatttttttgacacaaggcagtggaagcccctgataattggatttgatgatccacttgagcagatgatgccccaaaacttcaaataccatgcagatatgtgttccattaactcctgatattttaaagtcatctagtagttgaacaaccat

SEQ ID NO: 11046 - DNA, 366 bp, Homo sapiens
gtaatacgactcactatagggcgaattgggtaccgggccccccctcgaaagcgctcaggaagctgaccttgaagctctccagcacgggcagcaggccttggcggaggtcctcgagcgcgggcttggccttctcgctgagcgtgctcagatgctcggtggccttggcgtggtactcggccagtctggcgccgccgttctccttgagagcctcaaggcgcgcggccaagcgctggcgcagctcgtcgctgtagggggccagatgcgtgcgcagcgcgtccacatgggcgcgcgcgcggtcgcgcatctcctcgcccagtgggctcagcttctcttgcagctcgtgcagcttctggcgcgcgccctctt

SEQ ID NO: 11047 - DNA, 241 bp, Homo sapiens
  misc_feature 40, 190, 233: n = A,T,C or G
tttcaatttcgttaaatgaaattgtattttgcccacggtngcttctgtttgatccctggggacagaggggagcaagggaggggagtggcagggggaggcccaggtgtggggctggagggggtactggcggcacgggaggcagtaggcttgggcaggggaggagtgcgctgcgcctcaggaggcaaaggtnccccagcctgggcaggccctggaccagcccaagctgagcagcnccgcccct

SEQ ID NO: 11048 - DNA, 421 bp, Homo sapiens
  misc_feature 298, 405: n = A,T,C or G
tttacaaaaaaatcaagtttttatttcaaatatttgaatctaatagatcattatttaggtttatactctgtgaatatatatatgatattgtatttaattaatatctgagtaatctcaattaccattttctaggaaggatagagtgtaagagctaaacatttcatgtagaaatattaactttcaaaagttataataccagagttttagagtgaaggagtatttaaaatgtgtctttctttgggagagaatcattttgttctttactaacaataatttgaaaattggtaatttaatatcntgtgaatatgaaaatattatggtatagattagcttctaggagaagttaagtgtagcatgatttcttgaagattaaaaaaacatttaactttttaaagataatatgcntattgaatattatttg

SEQ ID NO: 11049 - DNA, 453 bp, Homo sapiens
  misc_feature 448: n = A,T,C or G
ttggcaggccaaaaccctagtttatttcagcatcagcagtatcttagccatcaaaaaaataaactctaccaagggtgacggaagtctctacagcaaggctaagggctcgccagacgggaaccatcaggggtgcatggtgggcactgccaggcaataagttaggaagcagcagggctggtgtcgggtgtgggccgggcttcatttctgggcaggcatgaggtcgtcgatggcctggccctgctccagccgctgctccatctcgatgagcagcttcactccgtccaccaccatctgcaccagctccacctctgagaagcccaggcggtcagcgttggagacgtcgaagaccccgcccaccgcagccgtgtccacaccgcctgtgcctcgcttctgaagtcgcagccgcttaagcacctccgagaacttctcatgcttgcccaggttgggnagctt

SEQ ID NO: 11050 - DNA, 286 bp, Homo sapiens
aggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgtttta

SEQ ID NO: 11051 - DNA, 549 bp, Homo sapiens
  misc_feature 549: n = A,T,C or G
ctcatgtgttccatttattttgtctctcaaattttaggaatcttctcctttaattaactcatcaacctctcatggcaagaatttgagaaagtaaatttatactcaggttctaattttaatagggaaggaagaagttacagctcagtgcaccatgaagttgagacagagatggagacacctcagccccacctctctgcaacaggaaagatgattggggagggagcacaggtcagcgtgggaagagggtcatggtggacatgggggtggggtggtctccccaccttcctcacattatgcctacatgaacacagacacatgcaggtgcctttgcaggaaacaaagtccagggttcttccaagtccaccaaagggaagggcaggaacaactcttgcctctcagtcccacacaaggcagctgtctcacactttacaagctgtgagagacacatcagagccctgggcactgtcactgcttgcagcctgagagtagctccctccttttctatctgagctgttcctcctccacatcacagcagcgaccaaagctccn

SEQ ID NO: 11052 - DNA, 658 bp, Homo sapiens
  misc_feature 361, 365, 372, 375, 377, 380, 394, 396, 399, 410, 413, 428,442, 494, 501, 506, 559, 562, 571, 573, 579, 596, 598, 605,628, 632, 638, 642: n = A,T,C or G
ggggtagggtcatgctattgcaaaactccacagggtaccatttatgttgtattccatgtggaaggtgtcctctggagtttggcaatatagcagctgtctgtaaatgatattgaaagcatcctgagttctggagctgcgccgattctattaggctgagaaccccagtttcaagttcatctcttcatttttctctcattccatttcacagcggcttaacagcaggtcctttgtattcgtttctggcccatagagggatctttattcaaaatcacagggttgtctctaaatttctgctaagctaatgaatggtgttagtatgttctcttctccagggcagaggcagagttttttttttttttanttanccaaaancancnttncccaataaatcacntntcnttgtaaaaaanaanagttaactattatanctaaaagataaaangccatggcattcaggcaacgggggattaaaagtacttcaaacctatcagttntgtaaancctancttaagtctgtgggtctaactttctaactaaacttaccttcctttaaaaaatnttngatgtgcananagctanactgaggatctaccagncncagatcnccttatttcaatcaggacctaanattntttgangccngggtttaaaccccttc

SEQ ID NO: 11053 - DNA, 205 bp, Homo sapiens
aaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctctt

SEQ ID NO: 11054 - DNA, 693 bp, Homo sapiens
  misc_feature 1, 29, 149, 168, 169, 172, 189, 207, 238, 261, 328, 362,455, 499, 508, 563, 578, 583, 596, 630, 641, 670, 688, 689: n = A,T,C or G
nattccaaatgaggagtatgatggacagnatattttagtatctcagtaatgtcctagtgtggcggtggttttcaatgtttcttcatggtaaaggtataagcctttcatttgttcaatggatgatgtttcagattttttttttttaaaanatccttcaaggaacacagnncanagagattttcatcgggngcattctctctgcttcgngtgtgacaagttatcttggctgctgaaaaanagtgccctgccccacaccggcanacctttccttcacctcatcagtatgattcagtttctcttatcaattggactctcccaggttccacanaacagtaatattttttgaacaataggtacaatanaaggtcttctgtcatttaacctggtaaaggcagggctggagggggaaaataaatcattaagcccttgagtaacggcagaatatatggctgtanatccatttttaatggttcatttcctttatgggcatataactgcncagctgaanatgaaaggggaaaataaatgaaaattttacttttcgatgccaatgatacattgcnctaaactgatggaanaagtntccaaagtactgnataacatcttgttattatttaatggtttctaaanaaaaaaggtanggggtttccaaagggcctataaaacattnttgtaataaaacctggtnntacc

SEQ ID NO: 11055 - DNA, 718 bp, Homo sapiens
  misc_feature 5, 7, 12, 34, 177, 630, 647, 674, 705, 713: n = A,T,C or G
acagnanggggnaaaagatcctcaggagcacagnaatatgccctgatggaaagtttgccccttgggcaaagagacagccatgggaaccttcagacatagagagagaaggtggcttttctccctacattcctcaaatagctaagatttggccagtgtgttttctaagtcaattctagngtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagggggaagaggcaacagcactgagagtcataggtagaagaatcatcacagccctgctaaccaggcagctgatgcccctctcccctggctccctgtgtccaaatcctacaggggcatctgttggctgaactcaacctgaagccaaganaaaatgagtggaaagangcacatttatagagctcaggtttctanggctggagaggatctggagggaccacagganaccctgcntaacc

SEQ ID NO: 11056 - DNA, 661 bp, Homo sapiens
  misc_feature 552, 582, 610, 640, 650, 653, 654, 657, 658, 659, 660, 661: n = A,T,C or G
ggggaatcaggaaacaaatcaacaatcaactggaattacaaccaaatctatgtacttctgttgtgagatctttttacttgcaatcctttgcaaaacgtgctgtgcacaatgtagtaagtatgcttgtaataaacaattaaaggagcttttcacgtgtagaagtgcacgcttaatttttgttaaatcatctcaataaatacttataagtgaagccaacatgattttcttaagttttttgaaaatgtgtgtacctataactgctgtgctatttgcaagaggcagtatacacacaaatttgatgatttcattctttaccaaatactatatttagcacattaaatactaagaaatagcactaaaatgggccgggcctggtggctcatgcctgtaatcccagcactttgggaggccgtggcagacggatcacttgaggtccagagtttgagaccaacctggccaacatggtgaaaccccgtctctactaaaaatacaaaaattgctggcctgggtggtggatgcctgtaatcccagctactcgagaagcttgggcangagaatcacttgaactcaggaggcggaggntgcagtgagctgaaatgtacactgcctncagcctgggcataaagcgaactcacctcanaaaaaaaaanaannccnnnnn

SEQ ID NO: 11057 - DNA, 361 bp, Homo sapiens
  misc_feature 1, 14, 16, 18, 25, 53, 59, 65, 75, 77, 79, 84, 88, 92, 105,107, 108, 114, 124, 132, 161, 164, 183, 186, 187, 191, 197,202, 225, 234, 235, 238, 240, 243, 261, 271, 279, 280, 286,290, 313, 315, 318, 335, 340, 342: n = A,T,C or G
ngacaacagaacgntncngctgtgngaacacctgtaatggttccgctgctaanatacanctgacnggtgcggttntnanaaaantacncaangttaccgctgctncnnatcaantgcttaggtncttgcttntacattaccacaccattgtccattttgcnagnaccctacagaccggtcctnggnncganatgacnacacnaatggtgcctttttcaaaaactnactactccnntgngngtncccaagccaggccctatngttctccccntagaggcnnactacntggnctacctgtcttactacaagtcananctntctgtgctacagacgantccangnctaatctcccactttacaa

SEQ ID NO: 11058 - DNA, 87 bp, Homo sapiens
aaagaactaacagatctagtgtttggtagcattttagagggaaaaaaggccatagctcaaatattgctctgatttcagttggctgaa

SEQ ID NO: 11059 - DNA, 781 bp, Homo sapiens
  misc_feature 1, 12, 28, 521, 540, 617, 632, 646, 655, 688, 727, 730, 762,778: n = A,T,C or G
ngggacacaggnaagggccctgacaagnaggatgggactgcagttgtggctgccaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaataaatgctgactctgagttgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatctgggtgtgattcagagagctgtttatgcaaaaccagccttgtcaccatcaggcaaggcacctgaattcccaccgcanagagtgctgtggccctgangacttttctgtcaccagccatttccaggtagacccagtgtaatcacaagcatccttgtaagtggcaaagaggcagangagacagcgccaganagcagctgcatganaagatcaanatgttgcttacttttaagttggaaaaaaaggcntgaacctcatatgtgggcggttctaaaactggagggcanganatgatttgaccttcacctcaggggcagctgtnctgcctactgatgganccg

SEQ ID NO: 11060 - DNA, 703 bp, Homo sapiens
  misc_feature 1, 2, 9, 515, 531, 547, 605, 620, 632, 644, 645, 652, 659,668, 670, 673, 676, 686, 687, 690, 696, 697, 698, 701: n = A,T,C or G
nncgacagnaaggggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagcttcccttatgggagtccttaaaagccctctggtcctggaggcaggatcatgtggtggattcttggcagtcagcagtctgtggagcttttgcaggtggatttgccgctgcagtcaccacccctctanacgtggcgaaaacaanaattatgctggcaaangctggctccagcactgctgatgggaatgtgctctctgtcctgcatggggtctggcggncacaggggctggcangattatttgcangtgtcttccctnnatggcanccatcanctgggaggntnatnttntggggctatnnccnaccccnnntgntg

SEQ ID NO: 11061 - DNA, 513 bp, Homo sapiens
  misc_feature 481: n = A,T,C or G
tggtctgtcaatgtctgtgggaggaagaagtggctcctcttccccccagggcaggaagaggccctgcggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtcgacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgnagacggtgctgggttgggtttcgaacaggcag

SEQ ID NO: 11062 - DNA, 526 bp, Homo sapiens
  misc_feature 141: n = A,T,C or G
tccaccgcggtggcggccgctctagactagtggatcccccgggctgcaggaattcggcacgagacctcgactcttagcttgtcggggacggtaaccgggacccggtgtctgctcctgtcgccttcgcctcctaatccctanccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctga

SEQ ID NO: 11063 - DNA, 629 bp, Homo sapiens
tcggcacgagctggtctgctaggcatgtgtgaaatccgctttgtggctctctgtgatttgttccgcttaacgtttttatttgtcttatttacacatgccaaggtggcaacgtgaaaaatgtctctgacgctattttccgactgtaaagctgagcattcgatataagtagctgctccaatctgtttggccatatttgccccctggtcataggacactggcgtctgcctgtgattggagagctctactaatgtactaacatctgtccgcagatcagacttgcagccgaccaagagcattttggtatttggacaaaattcctggatttcacctttccactttttgaggacactgtccagggtctctggtctactgatgtcaaagcaaatcagcacagcatccgaatcagggtaagagagggggcggacattgtcatagtaaggagaacccgaagtgtcccacaggctcaactctattctttgtgtgtcgatttcaaaactggccgtgtaattctcaaacactgtaggaacgtaattctcggggaagcagtccttggcgaagacatggagcagcgcagtttttccacactgactgtctcccaccacaactatcttgcatttcacgttctgatt

SEQ ID NO: 11064 - DNA, 608 bp, Homo sapiens
ttcggcacgagggctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacagagagatcttcctaatgccttggatgagaaacagctaattgaaaaaatgaatctgtctgcta

SEQ ID NO: 11065 - DNA, 898 bp, Homo sapiens
  misc_feature 732, 733, 822, 895, 896: n = A,T,C or G
tgcatgtagctgaccagcctaccagatcttttatgcagttcgacatacaaggtgacaccaaggtaagacaaatgaagttccagtttgggtttggtgtaaattctcactagtttcagatagtcccagatcttttccaataggtcatcaaaattccagcggtgatgggcagagatgggtacacagtgaggcaccttatagatgatatccaattcctcaatggagatttggtcaatcttatttaacacatagatacaggggatataaactctgtttccttccaccacatcaatgaggtcatcagctgtagcatcactacgtagagtcacatcggcattatgaatctttgattcagccagaatgctcctcacaagttcagcatccagctcactctggggggcagtggctgtgagattaatgcctcccttgtccttctttctaaagcccaatgttggggggtttgctgttcaagcgaatgccaaagccttccagctcattttcaattatcttcttatgtcccaaaggtttcaggacatccagaacaatcaagatcaagttacaggttcgggccactgcaatgacttgacgacctctacctttcccatccttggcaccttcaatgataccctggagatccaggagctggatctttgcacctttgtatctgatgacaccaggcacagtggtcagagtagtgaattcataggctgccacctcagaatataccccctgcanngttacctagcagtgttgacttccccacagatggaaaaccaacaaatccatttcgagcattcactgtcttggccacatcaaaaccttctnctgggactccaccaccaccaaccctttgaaggtatgagtctcgacgaagcttaacaagacgagccttaagcanncc

SEQ ID NO: 11066 - DNA, 259 bp, Homo sapiens
tctttttgtttcccaacactcaaagctccactctttccctagaaatctgaacacaccatttccagaggggttaccttgttggcacaaactacaaatataatattttccatgtttccatgaggtccaagctcttgcttcatttctgccagccacgcatcaagggcgtcaaaggagtctttctgcccaacatcatagaccagtatcacaccctgtgtgtccttgtaaaactcatttcgaaccttcaaataaaaggacagat

SEQ ID NO: 11067 - DNA, 398 bp, Homo sapiens
cggcacgaggcccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctaaaaaactttttaaaaaaaaactatttaaaactgtcaaatcctgaccagcaagcccccccccagccccacttccaagtgactccgtgccttgagtgtgtctgcgtgtttacacccgtccctttgctggccgcccccgtgcaagcggcacccctgccctgccctccacaaaattgggttccaagggctgttccaaacaactgccaacgtcactgagggccctgccccagcggccctggccccag

SEQ ID NO: 11068 - DNA, 809 bp, Homo sapiens
  misc_feature 8, 9, 10, 22, 30, 34, 36, 37, 44, 53, 55, 57, 58, 66, 68,87, 88, 99, 618, 709, 719, 731, 733, 756, 764, 766, 768,773, 775, 777, 780, 789, 803, 805, 806, 807, 808: n = A,T,C or G
acgatacnnncttgtcttgttncttttggnccgnanncggcctncggctgcgnanannacgacagnanggggcggctcgggccctgnngtttattcagnaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcangtttcacagttttacaagcatccatagatgctgccattatacagttgaaaaccaatgtttctctttggaagagctggagtcactaagctgntttatggganaaactgctgtgnanaatagatcctttcccgagagtantttaaatncnantatancntntcncctttggtncttttggcattctntnnnnc

SEQ ID NO: 11069 - DNA, 578 bp, Homo sapiens
  misc_feature 577, 578: n = A,T,C or G
ggcacgagtatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtattatacttgatgttggtcatttctcagtcctatttctcagttctattattttagaacctagtcagttctttaagattataactggtcctacattaaaataatgcttctcgaann

SEQ ID NO: 11070 - DNA, 613 bp, Homo sapiens
  misc_feature 1, 9, 556, 558, 593, 600: n = A,T,C or G
ntagacagnaaggggttgcgtcccatatctggcacccaggaaggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagnancaatttggagcggtaagcccccaatatgtgaaaangttttgngtacaccacctcc

SEQ ID NO: 11071 - DNA, 536 bp, Homo sapiens
agaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctg

SEQ ID NO: 11072 - DNA, 300 bp, Homo sapiens
gcaccagcaggtagtggcccctgtaagcagggccagagtcgggacaaagagcaggagtgaagcagccaagagacagaggaccaggctggagccagtgggcacgcaggagcctgcctgggaaaagccggggggcaaggctggcatgggaatgaacacctgctggtgacacctctctgagcttcagttcccttaactagaaaaatagaacaggcccggtgcggtggctcatacctgtaatcccagcactttgggaggctgaggcgggtggatcatgaggtcaggagatcaagaccaccctgg

SEQ ID NO: 11073 - DNA, 760 bp, Homo sapiens
  misc_feature 1, 8, 10, 48, 653, 675, 681, 698, 705, 723, 724, 725, 728,731, 737, 739, 748: n = A,T,C or G
nagacagnangggggttctgtatatgaaggtggtgtgttttttctggnatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttcggatatcaaaatgtattttgtgatgtactaaggatactggtcctgagtctaccaatattatagtgcattttagcctaattcattntctgtatgaagtataaaagtanctgtanatggctaggaattatgnctttgtntaaaccaatcttttctgnnntgnggntatgcngngggaaaagntttacctttact

SEQ ID NO: 11074 - DNA, 777 bp, Homo sapiens
  misc_feature 11, 13, 15, 16, 39, 50, 666, 671, 677, 719: n = A,T,C or G
gttctaatgcntngnntcatcctttcttcaaatgctgtngttcttttgcngatccctcgattcgaattcggcacgagaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagaccaataaattgtattcctacagatattcacctaccacttcccatgttggggcatgaaaagtgaacaataatttgactatagagattatttctgtaaatgaaattggtaagagaaccatgaaattncatangatgcngatgcagaaagcaacctttttgaaagtttatataatggtttnacccttcataaccagcttaacctttcactttttcttattttggatttataaataagaa

SEQ ID NO: 11075 - DNA, 845 bp, Homo sapiens
  misc_feature 2, 5, 9, 14, 21, 22, 33, 44, 53, 63, 66, 74, 76, 718, 721,740, 742, 748, 753, 755, 773, 781, 807, 815, 827, 829, 830: n = A,T,C or G
antanttgnccttncgataanncttgtttgttncttttggccgnagcggcctncggctgcganagnacgacagnanggggcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacggctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaacaaaagcctggccagggaactccaaattcagctaatacccaaggaaattcacacaaatcctcagtccctgatacccctccaactttttttattcttattactaccanaanaactatgagatgatgtttncntgctgntaaanantccctggcttaaggaagncctctggnccagggagcatgactttttttgtganttaaaaanatggcagctgancnncaggtccttacaggt

SEQ ID NO: 11076 - DNA, 396 bp, Homo sapiens
tgacactatagaacaagtttgtacaaaaaagcaggctggtaccggtccggaattcccgggatatcgtcgacccacgcgtccggggccatggtggcgctgaagggtgtccccgcactgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgc

SEQ ID NO: 11077 - DNA, 489 bp, Homo sapiens
tttgtacaaaaaacaggctggtaccggtccggaattcccgggatatcgtcgacccacgcgtccgtgaagtagtacccaattttaccgtctttcatataaatacttgaatctatctttttctatatggtgatgtctcagcatcatttaatgaagactctcattctttgcccagtgatttgtgatgttatctctgtcatattccacatttacatatctaagtggttttattcgtacgctctctattccctgtggcaatatcacattgtttagtatagttttacatgataatgtagtatcaatattcaaaaggataaccaccctgcttttttcttttcctccttctctgcctccttctcctccttcttctttgcaattgtctagcctattcttgaatttttattctttcatatgcatttaagaatcatcttgtcaagttcttcgaaaaaccctactgaaatttttattgaaattgtattgaatttatatgtg

SEQ ID NO: 11078 - DNA, 518 bp, Homo sapiens
  misc_feature 357, 472: n = A,T,C or G
tttgtacaaaaaacaggctggtaccggtccggaattcccgggatatcgtcgacccacgcgtccgcccacgcgtccgaccatatcacctcacatagttttactctttgattatcacacccacctccctcctgcacaccaccacttaccaggttgtctaactccatacaaccactactctgttttccatttataaaattttatcttgccaggcaaaagcctgtaatcccagcactttgggagatggagacaggcggatctcttgaggccaggagttcaagaccagcctggccaacatggcaaaaccctgtctctacaaaaaaatagcttggtgtgatggcacatggtctgtaatcttanctactcaggagactgaggcacgagaattacttgaacctgggagatggaggttgcagtgagccgagatggtgccactgcactccagcctgggtgagagagcaagactctgtcttanaaataaataaataaaataaacaaacaaataaataaaattttatctc

SEQ ID NO: 11079 - DNA, 516 bp, Homo sapiens
  misc_feature 514: n = A,T,C or G
agaaaaaaaaacttctttaatgggaaattttacgattgaaatgatgtttcatcttatagaccacaaacaaatgtttttagacattgaaaagtggttaaagaccaactgcgcccagtcccccaagtgccattttctgagtgcagaatggagggtgacgtcttgagctgatgctgtgtccccagcatcaggttttctgttttccctcttctccctttattccttccttgtccattgccctcaaccttctttttctgtttgctctggcctggttcagtataacatatccatgaactctaatattggccctggtccaggagctgtcctgccatggctagctcacggcttgacagcaatacttcttctccttctccgcccagcatagacttggtcacctttgtctcctttttctcccttgtgtcctcgagggccaggtggcccaggatgacctggtggcccagcagggcccctgtcacctttgggtcctggagtgcccatctctccttttgccccaggngt

SEQ ID NO: 11080 - DNA, 595 bp, Homo sapiens
  misc_feature 409, 456, 483, 508, 525, 581: n = A,T,C or G
aactgatgactctgctgtcttccctccaagggaaaggaaagagaacttactgaatagcaccgttcttctatatgtgattgtcaagtaggacttctgtaatcatactgaaggtaatacattgtaatcatgctgaaggtaatcatctttgccccagctttggatggtgtttctcacccaggctccttcaccaggcgtggttcatgcagacagccatgcagcagtaagcctttcaagggtcaggccctttgttaaatgctcgctgaccagcctgcatggtgcaggaggctggctcacagaaaccgggaagcccaggaggtcccgggggtccaggcactccaggaattcctgccacccctggggggcctcgctcaccgtctcggccatttctgccatagctggcagggcctgngtcacctgggagacctatagctccaggcaaaccgttgggacctcttnctggagggccacgctcccccttttctnccaagtcacctttaggtcccctcanaccaagagcaccagggngccccttaatgccccggaggccacgaattccatctggcctgggaaccattctctcncagagggccggggg

SEQ ID NO: 11081 - DNA, 631 bp, Homo sapiens
gtttgtacaaaaaagcaggctggtaccggtccggaattcccgggatatcgtcgacccacgcgtccgcggttccttttccttgaggcagtagacttttctcccaagaacagcaggagaagccttgccagagcacatagcgtttgagttaattgagaaaagaaaagagttctctagacagagaaggagggacgaacattatagacagaacagcagagtgaagcctggaagttcaagatcgtgtgcccaaaatgtgaggatttgaggcagaatatatcagatgagaatggtaaaggaagtgaccatcctgatatattctgtaatggctgaatcggagtgactacttagaagggaattacagggctaggcatggtggctcacacctgtaatctcagcactttgggaggctgaggagagaggatactttgcggccaagagtttgagacaagtctaggcaacatggcaaaaccccgtctctgctaaaaatacaaaaatcagccgggcgtggtggcgcatacctgtaatcccagctacttgggaggctgaggcaggagaattgcttgaacccgggaggcagaggttgcagtgagctgagatggtgcccagtctgggcgataaagcgaaattccatctc

SEQ ID NO: 11082 - DNA, 463 bp, Homo sapiens
  misc_feature 293, 391, 392: n = A,T,C or G
tactttttatttttattttgggggcttttaacataaaaatacagatgctcccgtcagagtaaggcatcgcaaccttcagttcttccgcagcaccgggagtcgagggggaggcatggagcgcgggaaaaggaatcgagcgagggaaagggatggagcgtgcggcgcccccaccacctcggagccagcggagggcggagggcggcgcaaaagccgctggttggggtggcgagggaggggagacccgggagccgagggtaggttcctgccggtgtttgggtgccacggcgcgcggngctagagcgcagtgtcaggcgcgaggtcctgcagcgccccctcgcgggaatagaactcgtcgatcaccgcctgcggaatgcgcttcagcatctcttgnngggaggatgcgcagcagcttccagcccaagtccagcgactcgacacgttgctgttcttgtatgtgcctgat

SEQ ID NO: 11083 - DNA, 698 bp, Homo sapiens
  misc_feature 387, 476, 535, 625, 659: n = A,T,C or G
atctctgcagtttataatactctacgtatatgaatttaaagcagttaaacaacatttgagattaaattggtaaaaaaaaaattgtaattgaattcagacttcagaaaattgtgaagtaaaaggccatgatggagaaatattaagaatctgtagaattactaaactgtcacagtattattttcctttacaaaagcatctcagtaaaacaaaaactacagaaaacgcaaagtaaaatcagagattttggtttagtactttccctgagtctcttgttttaaaaatcaaagtaaggccagttcaaaattgacccacaggtcttgcctcctccatgctgccatggggagtacatttaagacaagaggctacgcatgttgaggtggtcccagngctttattcaaatgccaatttgcccgtgtcactgccacagggttatctgacccactgctgcatgtgggcttaaagagctgtcaaaattntatcttggcctgctataatataatatgcgagactatataccacaagaagacaaacagtntcacgtattaataaatattacatttctaaatggatctcgacactatatacatcacaatattgtaacataacagaagctacacttttatgnttaaaattcttacataaacacaggttcgcgtcangtcatcttaaactctaatctacatgttacagataaactc

SEQ ID NO: 11084 - DNA, 567 bp, Homo sapiens
  misc_feature 541, 560: n = A,T,C or G
tttgcgtctctgaaaattttaatttgttctgacaacgaaactaacacagcataaggacttaagccctcaagctaggcaagacactgatggcccttggaggacctcggggctgagccacggcagaaccttgacactgtacttgggaaaatcgtggaccactcgctgccgctgcccatggcttatcatgctgaggttgctgcgcaaaccagacaggtagaccttcccatccacagagatcaggatgtggctggctttgacactcctgtgtacatatcccatgtggtggatgtagtcgagggccttcagcaccccctgcaggatgtaagcaatcgccagctcattcatgccatccatgaagtgtgtacagatgagatcttttgcagaaccgtatgccatgaatgatgtgacaacccacagctcattgtctgcaattaaagtggctcgatatggcacgatattgggatggttgagagtttggaacatgcagctcgccctgcaagatgttaccatctcattggaacaagcttctaagttaattctncgtacaggcacgtactctncgtgtgg

SEQ ID NO: 11085 - DNA, 451 bp, Homo sapiens
ctccaataagacacagtagagtctctagccaaagtgattgaggtcccttcatctctgctgtttgttcaatgtaaattagccatcatcctccctgtttgtttttctcatcttcccacatgggctcaacaccatccttaaaaagtgagtagtcacagccagacattaaattactagacaactggatatggttgtacagagcccaaaagtcaacaggatcaaacttagagatcagcggcaggtttgcttgtcaagttttgcttttatcttttttaaaaaaaccagagtgcccatctgttctgtagaggatgtttaatatagtgttctgggttagcaacctcctgattagattctgttttctcctcttcacagggggattaggagtaggggtggtttctggtttgacagtccgccgtcttacatcgatctgctcctgcttttaactctgctcttg

SEQ ID NO: 11086 - DNA, 152 bp, Homo sapiens
  misc_feature 39, 78, 87, 101, 105, 116, 118, 119, 122, 123, 124, 132,135, 141, 142, 143, 150: n = A,T,C or G
gggatctcttccaaaggctcactctcaagcacgactaanagccttctgagcccagcgacttctgaagggccccttgcnaagtaatanggcttctgcctaancctntccctccaccntnngcnnntttcttanctntcctannngccttgncc

SEQ ID NO: 11087 - DNA, 788 bp, Homo sapiens
  misc_feature 10, 626, 687, 719, 758, 761, 769, 770, 774, 780: n = A,T,C or G
aaaaccaagnatatcttacttctctacctacaaccttctttgcataaaatgatctaatgcaatccatgtaaaatgatatcaactatagaataagccagccaattttggaataaggagaggtattaaaatagattgctttgatttaagtctcctgaacggtaggttacattgaggctctcgtcggagcactggccagccggctttccccttcattccatgtgttgtaatgtgttaatatgcccagctgacgtttttgtctgtttcttagtttgacatcaacaacaagatcgagttctgacgctctgcaggggcgatacgcagctcctgaattggaggtaagttcatttccttttcctgtcctgcttcatctcagaagatccatttctcaggagggccttttgtgtttgtgtctttatcagtctgcattccgtgatcctgtttttctgctgaggaaagatttttgtatagaaaaataaatgctggccgggtgtggtggctcacgcctgtaatcccagcactttgggagtccgaggcgggtggatcacctgaggtcaggagttcaagaccagcctggccaacatggtgaaccccatctctactaaaatccaaaattagccaggcatggntgctccacctgtagtcccagctcttggaggctgagacccagaatacttgaacctggggcanagttgcagtgagccaagtctacactgcctcanctggcataagtgccttgctcaaaaaaaaaaacccgggcnttncctaaccnntaanacttgngtgccccc

SEQ ID NO: 11088 - DNA, 712 bp, Homo sapiens
  misc_feature 577: n = A,T,C or G
ggggggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttactcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttcttggtacagtggggcaaattatttgtattaagcaaacttttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaggaaangattttaaccatagagtaggcatcatggaattcaaccagattctaatacctggtcttctcaagagaatatacagtatagtgggctggacatatggcgatattgatgaattgatactgataaagctggaatttctc

SEQ ID NO: 11089 - DNA, 794 bp, Homo sapiens
  misc_feature 554, 578, 594, 655, 695, 731, 739, 743, 755, 766, 772, 785,787, 789: n = A,T,C or G
acgacagagggatacattgaacatgtattgagagcctaccactgtacttagtgctgggggttggggtggcaaaaaaataagaattagtctcttccctctagaaagaaacttagagtctaataaagaaagatggaaaaataagatgttccatccttgttgtagagttgtagaagtctctgttgggtacatgggtaacaaatgtgaaaaaatataattctgaggaagggagatacaagaaagctttcatttaaggtagttgacacctaagtcttgctctgtggttgacgggtaacaggtgtaagttgttcaagccagagattactagtttggcttcagaagacatttgtcaaggtagaagagtacaatttagaatctgtgtattcatgataataaaagctctggggaaaatggggacaaataaaaaatagaatcctaacagatactactgggtagagcaagaacatatggacagaaagataatgttggcagtctttggatatgtaatctatttaaaaatacaccttctaagtaagtgtcttatagaaaagatagangctgggtgtgatggctcatgccancaatcccagcactttnggaggcagaagcaggaggatcacttgagctcaggagtccagacagcctggcacatacgatncccccctttcacaaaatccaaaattagctggcatggtacnccatgtccgtgttcagcttctcaggggctgacctgnaggatccntganccccgaagtganctctggagccngatccncctgcccccaccngngnaaaag

SEQ ID NO: 11090 - DNA, 926 bp, Homo sapiens
  misc_feature (1)...(926): n = A,T,C or G
nacgacagnagggtgcggttgcgagaaangcgacnntaagggtacggctgcatacaatacgacagcaagggtacggtgtgcgagcattacgacagtaagggtaccngctgcatacnagnacgacngtaanggtacggntgcnacnaantactanantgnggnnnnnnnnnnnnnnnnnnnnnnnnnnnnnnnnnnnnnnnnnnnnnnnntcatgggtnctgctgcagagaagactactnnnnggtacggctgnnacattactacagtatgngtactgctgcatagnagacgacttctagggtacggctcgcgngaacacgacattaagggtacggctgctattaagacgtacacaagggttcggctgcgaccaagactaccnatnggtnctgctgngannagacgacatangggtnctgctnccagnngactactnngnggtactgctgcgagatgactncatatgggttnggctgccataagactacacngggntncnnctgnctcagacgactganngggcctttttcacacnatngctncntgtgctaacnnanaagntnctnncccttctaacgctnaancctaagccattgctntncaggccctatcgtggtgttgaaggtggcacagccacacatnaagaaattccccgtntcccatcttgnnngncgngacctgcnactctgnacngtctantntntncganatgcttctcnanntcacctcgccctttcttnataagttccctgccctgatctgctgagagtttanaacaccctntttntntgnttttgcancccccattaangtttaaaactttacttttgcnggcancctgttcnctttgaaaaagcttttcntgctctntcncttgtttnccaatggtttantgnccnccttnattttttttttncaaaaaaaat

SEQ ID NO: 11091 - DNA, 831 bp, Homo sapiens
  misc_feature 635, 642, 657, 666, 671, 680, 709, 714, 731, 752, 757, 763,766, 770, 774, 801, 810, 811, 819, 821, 826, 828, 829, 830: n = A,T,C or G
gggaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgaagtcttttgtaaggcaagaataaatatatcnagacatntattagtttctcagnttttccaanattanaaattactnatattggtggctgccatgaccccttgtcnggganatgtacttatcttgatntctatctcaaagtatctcccntgatnatttcnatnatanagtncgtttctgcgggcaaatttgtatagcnccctggaannaaattttntntgttnannna

SEQ ID NO: 11092 - DNA, 732 bp, Homo sapiens
  misc_feature 607, 635, 670, 675, 706, 718, 730: n = A,T,C or G
gggaagattattccattttgttaagattaaaaatgagcagtcaaataattctttctctgagagaagagtgtatggtaggtccattgagggtgtctgttgtatcttaaaatctattcgaaatgtttgggtgaattattgtctaaattgacagatgattgcttttgagctaacaaaatatttctgttagcatagctaaagaatatatgttaaggaatatatgctctttgtaagttttgattgagtagataagatgatacagacacatgaatcaggaaacaaatcaacaatcaactggaattacaaccaaatctatgtacttctgttgtgagatctttttacttgcaatcctttgcaaaacgtgctgtgcacaatgtagtaagtatgcttgtaataaacaattaaaggagcttttcacgtgtagaagtgcacgcttaatttttgttaaatcatctcaataaatacttataagtgaagccaacatgattttcttaagttttttgaaaatgtgtgtacctataactgctgtgctatttgcaagaggcagtatacacacaaatttgatgatttcattctttaccaatactatatttagcacattaatactaanaaatagcactaaatgggccgggcctggnggctcatgcctgtatcccacactttgggaggccgnggcanaccgatccttgagggccagagttgagaccanctggcaaatggngaaaccccgctntc

SEQ ID NO: 11093 - DNA, 547 bp, Homo sapiens
tcagaaagtacctataaaaagtaaaagaccacattttagggggagaaatataaaattatggtgaaaggccacgctgtgaaaagtacttggtttacagtacctgcggtgttctccactggggcctgtccagagaggcagatgacactcacctcatcaactggcaatgaacagcagctgaaaagggtggctgctggactggggactgttcttactcctaagtgaaaccctaccttcctgatactcatggagaacactgcagttacgaacagaccaaaacaaggagctgcaaatgcagaactcactgggcaaaaactgacagatgataccaaagtcgtgaaagtatctcatctcaaaaaagataactacaatctcaaactttcaaaaaatgcagatcttgctcagaataaatcgtaacaatctcaaagtgcatttggatgcagaacgtatatttacgtatataagctctttcttgttctcgagtaagtccagggggaataactgtaggcattcctggaatcactgtcttctgttccattgtgtcatggtt

SEQ ID NO: 11094 - DNA, 364 bp, Homo sapiens
tggtacgcctgcaggtaccggtccggaattcccgggtcgactactactactaaattcgcggccgcgtcgacgatgtattaaggctgggcatggtgactcacgcctataaccccagctccttggaaggccaagacaggcagatcacttgagctcaggagttcgagaccagcctggccaacatggtgaagccctgtctccactacaaatacaaaaaattagctgagtgtgatggtgcacacctataatcccagctagtagggagactgaggcaggagaatcacttgaacatgggaggcagaagttgcagtgagccaaaattgtgccgctgcactccagcctgggtgacagagcgagactccgtctc

SEQ ID NO: 11095 - DNA, 776 bp, Homo sapiens
  misc_feature 556, 667, 670: n = A,T,C or G
ccctacaaaataatttattggaacacacagctacagcactctatgtacaagcacattgacgctcctgactatcctcaactaggggacccttttcttcccccttgccttgcggacctcttctatcaaatctttcaggtactggatctccttggccagggaatccgccctctcttttagagcctcgttcttcttttccagctctttgcactcaccagtaagagcctcctgctccgccctcttcttctggcggtacctagtggctgctgtcttgttttgctccatttttttcagcttcttatccagtttctcaccctttacttttgctgctaccatcttctctccaggaggatcgtaaggtttgggacgggcagacccacagagaacacctggagatgggaggctcctatttggagagcccctggtagaggggctgtgctgaggagaccccagataggactctgggctcatacagatgccactatcattatctgaaggggtgtcttcctcctttatgcactgagggatcatggcaacgtaagcagtgtagtctggcttnctatctccttcagtgatatccacttcactgcccagctctaaactaaaggaatgatctgtagtggaggacaggacccctgcggaaaggtgaagagggttgtagatggtgaanggngcaaacctgctcgggtttttgtaaactttctgggagatgccaatttgtgtcaccgtctggggggggctgctattagtctcctggacttaggggggcaagagatcac

SEQ ID NO: 11096 - DNA, 254 bp, Homo sapiens
tatgacgtcgcatgcacgcgtacgtaagcttggatcctctagagcggccgcctactactactaaattcgcggccgcgtcgacgtttaaatcatactgctaatttttgtaaaaatatttttgagaattccacagatgattttgtattaatattgaaaattggttgatctaactcacttattaacatgttcggggtgtgacctgactgtttatgggtaagatcatgatgcatgtttgcttgaaatgtcaccttact

SEQ ID NO: 11097 - DNA, 571 bp, Homo sapiens
  misc_feature 472, 506: n = A,T,C or G
cagcttattaaggtttttttaataaataaaataaacttaaataacaaaataataaagttcaaaaacaacttaaaatatagtttaatgctgtaaccataggaaaaaagcatgattatttgtgggaagaacattattaaaagccatattcccaaatacgaattatacaaagatagattatgttacttgaaaaaaacttaaagatttctcaattttactttgagaaattataaaatgttattttgtggcaagtaagatgaagtacagtattatcatcaatcactgttgctatcttatatacaagatttttggaaacatccttttagcaataccctttccacttgagcagcattagaaattttgttcttgttaataggtataagcatgttctaatcctgtacttttgttaaattatctattttattgactttcgtaatagatttttttgagaatattctttttttctgattagagntaaagtagattataatttttcactagaaagcatntaaaatgctgctcattttctatagtagtgtggcttgatatctgacaatcctgcagcagcctgtag

SEQ ID NO: 11098 - DNA, 864 bp, Homo sapiens
  misc_feature 3, 12, 26, 597, 646, 664, 674, 684, 754: n = A,T,C or G
ttntggttaaanaaagtttaatgagnctgtaaaataaatacacttccattaaatattaaataaattatttacaacttgaaaaaatactttttaccttcgtgcacctttatatacagaaatagcataaaaagtgacaattgaaagtttaaaaccatcataacaaaaagggtccattgtcttatgatccactggaaagaggaccgactcatcatttatggctatgacttggcagtgactccaatgtgatatcctgtaattttatcttcagttatgctatagcatgtacatttccattctcttgtcgaagtttctttcgttcctcagcttctccttcatatttcctgacgtattgtcttctaagctggactggtataacagcaacagctgtgaggatcacagcagacataaaggcagctatggctgctaatgcaatttttgataaactactgtcaatcatgctgtgagttttcatggacttttccccacaccgttcaccgaaatattcttgctgacatttgcatgttactgcttccaggtgctctatatatttgcattctccgtgaatgcagaaattttgaaattctgcattacatgganttttcttctttctggttcttctattttttccatttttgcctcccttttntctttcttttgggttatnctgaagtatnttcacttttncgtcttgttttggggggggcttaactacctgttcaactctgactgaatcatcgacaatataggccagggnatttgtgggttcgtatcatactctttctgagtagtatagtccgctcccgaggacggtcactactagaaggcattcacttacaggggaaatctactccttgaagacatctc

SEQ ID NO: 11099 - DNA, 188 bp, Homo sapiens
aagaaatatgaagaaagttgctcattcttgtgtctttcagtcactccctcccaaaatggaggatgctcacaagctctatgaaacagtagaaaatgaagcaaaatgttacccgcaggcacttctggagtcacaatataactagaggggagagcatattcattcatctggagctataacatattgtttaa

SEQ ID NO: 11100 - DNA, 471 bp, Homo sapiens
tttgtacaaaaaacaggctggtaccggtccggaattcccgggatatcgtcgacccacgcgtccggtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtc

SEQ ID NO: 11101 - DNA, 441 bp, Homo sapiens
  misc_feature 441: n = A,T,C or G
aagaggttccagatatatatcttgatttaatcctgatcatccacattaaaattatgaatgtaaaaattacataataggcttttcggctgggaaagaaaagtgtctagcagcatgcacaaagaccatgcattgtcacatcatcaggcgaacaaatggaaaggtaataaataattgctcctaacgcccactttaaaatagtaaaaccaaatggaacagtgaagtgagccggtcttcactgctctgagcaggaagcgtgctagcggccagatggggccacagtcagatgacatggcaacagctggctgggctggatgcgcacagagcccctccttagggttccgctggatgttcacagagatggtcttttcgcacagaggtagctgcagcacgttatttttcaggttcttgctctttaatccgttccaattcagtggtggtatn

SEQ ID NO: 11102 - DNA, 326 bp, Homo sapiens
tcggcacgaggacaaggcttctggagccgtggggcacacctccacgggcaagccccctgcccggtcacccttcccatcacaggatctggcgcgatgctgtgggaactgttgcaggcgttggctctgaagctgctcagagtctgccctcacagcaaaagggaactgctgactgcctggcacttaggaggagctgacagcctggccgtaggtccagggtttaaggctgtgcggtgggtagaacagagaaagccgagatggccacggggtgtggctcacaattcactgttcttggcaggaagggggcagccactcaccattgtcacccc

SEQ ID NO: 11103 - DNA, 513 bp, Homo sapiens
  misc_feature 231, 344, 442, 462, 472, 480, 486: n = A,T,C or G
ctttacacagatttaagccaataatttttagcaaaatgatacaaaactgtcttaaccaagtagaagattggtagttacagtggaatcgtcagggagtacagggcggccaccactggagggagctgaggccctggaaaaggagtctgattctctgcaattctctctctgcttttcttcccagccccgttacaaccgagttcacgtggggggccgcagtgcagccccagtcgntggcagctcttggagtctgtccgtttagtatgtttcccccacgagcgtcgctggggtgagtggcctgggagagctcccggtgttaacatttcgatcctagaccgggggacgtntcactagtaaagccattggtaacagagtagatcagccatgcattgtctgccctttcacagcaataagggagagtttttcattcggtggcacgacagantgaagaccatgggaagccanccgaccaggnttccagtngttgcnttccgttgggaagacgaggcagttttt

SEQ ID NO: 11104 - DNA, 629 bp, Homo sapiens
tggactccaccgcggtggcggccgctctagactagtggatcccccgggctgcaggaattcggcacgaggggaggcgcggtgaggagtcaggcttaaaacttgttggaggggagtaaccagcctgctcctctcgctctcctcctcgtctgcgccgcgtttcacagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccatgaattttgtccaaataccaaaatgctcttggtcggctgcaagtctgatctgcggacagatg

SEQ ID NO: 11105 - DNA, 523 bp, Homo sapiens
  misc_feature 316: n = A,T,C or G
gcgaattgggtaccgggccccccctcgtgccgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtanggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctg

SEQ ID NO: 11106 - DNA, 759 bp, Homo sapiens
  misc_feature 238, 409, 439, 467, 553, 624, 643, 646, 665, 684, 703, 710,727, 730, 733, 736, 745, 754, 756, 759: n = A,T,C or G
cttttggcacaatgttgcaaggaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctangttataagactgttattctatagctccaacttaaggtgcctttttaattccctacagttttatgggtgttatcagtgctggagaatcatgtagttaatcccattgctcttacaagtatcagcttacttgtatcagcctccctacgcaaggacctatgcactggagccgtangaggctcttcagttgggccccaaggataangctactgatttgatactaaatgaatcancagtggatgtagggatagctgattttaaaacactcggctgggcacagtggctcacacctgtaatcccagcactttgggaggctgangcaggcagatcatgatgtcaggagtttgagaccagcctgccaatatggggaaaccctgtctctacaaaaancaaaaatagctggcatggnggngcgtgcctgagtccaactnctcgggaactgaggcaaanattacttgaacctggaggngaggtgngggagccaaatcgaccntgnctncanctggcgaanaacaaactntnccn

SEQ ID NO: 11107 - DNA, 785 bp, Homo sapiens
  misc_feature 1, 8, 262, 291, 299, 302, 382, 395, 426, 544, 550, 552, 599,611, 630, 693, 721, 724, 746, 778: n = A,T,C or G
nagacagnagggtgctcatggtcctctgggcaacctgacagtgccagcagattctgcagcatcttgactcagttactgcccaagaaccctgacaactccacaagggttttatttttaaaagtctacttcttccctacaatatagaacttccagaaaaggagctgactcccatgaagggcaagcagagccaaaagcaagtactatgcaagtgaaaactactttctaatcaagattttacaaatatatttcttttttttttganacggagtctcgctttgtcccccaggctanagtgcagnggngccatctcggctcactgcaacctccaccccccaggttcaagcaattctgtctcagcctcctgagtagctgggattacagngcccgccactacncctggctaatttttttgtatttttagtaganacgggtttcaccatttgagccagactggtcttgaactcctgaccttgtgatctgcccgcttcagcctcccaaggtgctgggattacaggcatgagccaccgcacggggctgagatttntaaatntntttcaaggaataggaagctgttattcccatgtgttgccttctctaanaacatcagctgngattaaatgtcctttcagnggaaaatttttcactgctccaagtcaaagcagtataactttaacaaatgatttatcctgagtntttattatccaaacctattcctaacgtnttntttggctgctggggggactganttacaggacttgcgcactgctgagggcttatnagacttg

SEQ ID NO: 11108 - DNA, 109 bp, Homo sapiens
ctgggtccgtctcgtcgcgtccgggttgtcactctctccggttgttactctgtagcttcccggctcgcgaaagggaggacctgtctgggtcatggattttgagaatctt

SEQ ID NO: 11109 - DNA, 691 bp, Homo sapiens
  misc_feature 464, 482, 553, 593, 599, 626: n = A,T,C or G
agggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgangtgggcggatcacttgangtcaggagttggagaccagcctggccaacgtggtgaatccccgtctctactgaaaacacaaaaattagacnggcatggtggcgcacacctgtaatcccagctacttgggangctgangcaggagaattgcttgacctgggaggnggaggttgcagtgagctaaattgggccaccgactcaaccccggggacagaggaaactccgtctcc

SEQ ID NO: 11110 - DNA, 786 bp, Homo sapiens
  misc_feature 1, 9, 11, 46, 123, 192, 255, 309, 379, 527, 615, 708, 713,737, 738, 781, 784: n = A,T,C or G
nacgacagnangggagtgtgttacctgccgtacagcataatgtgangcaaggtctagctgttccccccggcatacaagcttatagagcagcctcctttgaagatctccaggtggacttcacanagatgccaaagtgtggaggtgttcgagtgtggatcaaggactggaacgtagcctctttgtgcccatggnggaaaggaccccagactgtcgtcctgatcactcccactgctgtgaacgtagagagaatcctancctggatccaccacaaccgtgtaaaacctgcagcgcctgaatcctgggaggcangaccaagtctggacaacccctgcagagtgaccctgaagaagatgacaagccctgctccagtcacacccanaagctgactggtccacgcacagccgaagcgtgaggaagctcattgtgggcttcatttttcttaaattttggacttacagtaagggcttcaactgttcttactcaaactggggactattcccagtgtattcatcaggtcagtgaggtangacagcaaatgaaaacaatctttctgttctatagttattatcaatgtatgggaacgttaaaagagacttgattgtatatgccactcantacatgtatgtagcccaggaaatgactgacctgatgtgtggtataacccatctgaccccctacaccaccagttttgaataaaataaaactggnctttnctagggatccagtgaatattactnnacagaaaaaaggatcccaacagactttaaattgacctggcacntanaa

SEQ ID NO: 11111 - DNA, 766 bp, Homo sapiens
  misc_feature 470, 477, 505, 506, 572, 584, 603, 605, 616, 667, 676, 686,694, 698, 700, 712, 714, 717, 720, 726, 759, 760: n = A,T,C or G
gctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagtcagatgtcgatgccattccagcagtgggaagctttgaatgactcagtgaagacgtcaatgcactgggttgtcagaggtaaaaaagacctgatgctggaagaatctgacaagactcntccaccnagatggaaaatgaggaatgttatgagcnnagagaaagaaagaaagaggagctggcttcaccgcagagaaacggagcagaagaacccagcccctanaaagtcagtctncccccaaattcaaatcttnanggtttgcagangtgaatggtggcaccttcgtttccctggtccagatgctcctcaaactctgnggagttcanaacttgaaantgaaattnttgntncaaaatgagganancanaangccctngctgccacatcggctttttttgtcttaaaaggnngttatg

SEQ ID NO: 11112 - DNA, 781 bp, Homo sapiens
  misc_feature 1, 9, 560, 582, 727, 731, 739, 744, 750, 753, 755, 766, 769,770, 777, 780: n = A,T,C or G
nacgacagnaagggagagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcnaggatgactcaatcatcactgntttaacaggaaatggtgactattacagtagtgggaatgatctgactagcttcctgatattccccctggtggagtagaggagaagccaaaatatgccgtttactgaggaattggggctgtttatagatttcctagccttgattgcngggncatggtcngctgnggcatntcncncctcttggctntcnngccgggntgnt

SEQ ID NO: 11113 - DNA, 648 bp, Homo sapiens
  misc_feature 5, 7, 30, 644, 645, 647: n = A,T,C or G
acagnangggctctcggctttcggctcggnagaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccagggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtgggaatgcccagccagttaagcacaaaggaaaacatttcaataaaggatcatttgacaactggtggnnana

SEQ ID NO: 11114 - DNA, 208 bp, Homo sapiens
  misc_feature 2, 15, 18, 21, 22, 27, 29, 48, 49, 54, 56, 75, 81, 102, 108,129, 132, 135, 156, 162, 176, 182, 183, 186, 198, 200, 203,206: n = A,T,C or G
tncggttgcaaaaanacnacnnaaggntncggttgcaaaaaaacaacnnaaggntncggttgcaaaaaaacaacnaaaggntccggttgcaaaaaaacaacnaaaggntccggttgcaaaaaaacaacnaanggntccggttgcaaaaaaacaacnaaaggntccggttgcaaaanaccacnnaanggtaccgcttcnanaanacnac

SEQ ID NO: 11115 - DNA, 219 bp, Homo sapiens
atttaatgaaataatcgctaaacccaagatagtctatatttaaaaaatcccctctaatttgttgtcttgttttgttttggttcaactagaagagtgggccccacagtggggaaaaaaaaaaaaaccccacataatttttttcacataatttttttttatttccgaaaaaaaaatattgggaaaatattggcccgaaattttttttttttaaacctttaa

SEQ ID NO: 11116 - DNA, 417 bp, Homo sapiens
tcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctg

SEQ ID NO: 11117 - DNA, 779 bp, Homo sapiens
  misc_feature 8, 10, 547, 613, 632, 649, 670, 692, 732, 734, 737, 742,746, 768, 777: n = A,T,C or G
tagacagnangggcttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaangctacaagaagaccaaagaagctggtttgctccttaagaactaaagcctggatgatatcaaaaagnctatgcctctcacgaaganactgcaaggcaaatganaaccgcgccgtttcagcgcanggcccggcatatcttatgaganaatggatatcaggctcaaaaatcctggatacttgctatgnancanctgantttnactgctctggggctgggacttntctttgatnaa

SEQ ID NO: 11118 - DNA, 563 bp, Homo sapiens
attcggcacgaggggtacagaacccgctctgagccgtgggtctggctcctgtaggggactggctctcttggtgcaccaggggagggggacatatcccagtgaaccccaccttggcgcctgaggcaaaacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcggggggagggccaccgactggctctgctgccagcacaggcccctccctggaagtcctcgggagcggagcgcggatcggcacgggctctgggctccccgtggagagaagctgtagtttttac

SEQ ID NO: 11119 - DNA, 506 bp, Homo sapiens
ctaaacaggtgtctgtggagggcacacctgcttagcaggacacggggcccattcctaaccttgggggctcccagtctggtggtggagacatagtaagcaaggggtgacagtgccgtggataagctgtcccgtgtgaaaccaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggagccctcgccaagctcagtctcctcagccccagagatctggaagcccctcccaacagaggctctccccacaaggccagcagcccctgagcccccagtccggatctccacagcagcaaaggtcaccaggctctccgcagct

SEQ ID NO: 11120 - DNA, 559 bp, Homo sapiens
tcggcacgaggtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatg

SEQ ID NO: 11121 - DNA, 598 bp, Homo sapiens
  misc_feature 230: n = A,T,C or G
cggcacgagggaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttanacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcagtgctgccataaccatgagtgataacactgcggccaacttacttctgacaacgatcggaggaaccgaagagctaaccgcttttttgcaaagaggaaattcacagcaaaagtccacattatgtcagctttctcatattg

SEQ ID NO: 11122 - DNA, 575 bp, Homo sapiens
agcttgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctac

SEQ ID NO: 11123 - DNA, 523 bp, Homo sapiens
cggcacgaggagatttagcaaaattccaccgtatcttttgccaggctagagacagggagagcagagtaaaaccctcatgctgctgaaatttctaggctgttaggaagcccctcgaattctgtgaaaatgagggtttcttaactcacactgagagcggaaaggggcaaacccttttcataactccctcaagtgtgtgttacctttctttaccagcatggtaagcaacaggacatatcccatcctcggacatgtctgtatgatccaaggtacccaaagtcagacagagtaaactcaagcctggcactggctttctgccgcttcatgtgctttggaaaaagcaggacaagcaatagcagcaggagtccccagcagctggagccgcaagaatgaactgcaaagagggaactgacagcagctgcggctgcaggggcaacgacgataagaaatgttgaattgtgtggtggtgggggacggtgccgtggggaaaacctgcctgctgatgagctacgccaacgacgccttc

SEQ ID NO: 11124 - DNA, 632 bp, Homo sapiens
caagctacttgttctttttgcaggatcccatcgattcgaattcggcacgaggtggaagaaaattttttgctgcttctggttcccagaaaagggagccattttaacagacacatctgtcaaaagaaatgacttgtcgattatttctggctaatttttctttatagcagagtttctcacacctggcgagctgtggcatgcttttaaacagagttcatttccagtaccctccatcagtgcaccctgctttaagaaaatgaacttatgcaaatagacatccacagcgtcggtaaattaaggggtgatcaccaagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaattagctgggagtggtggtgggcacctgtaatcctagctacttgggaggctgaaccaggagaatctcttgaacctgggaggcagaggttgcagtgagccgagatcgtgccattgcactccaaccagggcaacaagagtgaaactccatctt

SEQ ID NO: 11125 - DNA, 300 bp, Homo sapiens
cgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctccttctgtcatgaatgtacagt

SEQ ID NO: 11126 - DNA, 92 bp, Homo sapiens
taatacgactcactatagggaatttggccctcgaggccaagaattcggcacgaggcgcccggccgtagcaccatgcctgcttgtcgcctagg

SEQ ID NO: 11127 - DNA, 55 bp, Homo sapiens
ttaatacgactcactatagggaatttggccctcgaggccaagaattcggcacgag

SEQ ID NO: 11128 - DNA, 118 bp, Homo sapiens
ttaatacgactcactatagggaatttggccctcgaggccaagaattcggcacgaggcctgtcaccacctgcacagcgtgacctcaggggttgcccactttacctttatggtgatgcct

SEQ ID NO: 11129 - DNA, 466 bp, Homo sapiens
taatacgactcactatagggaatttggccctcgaggccaaaaattcggcacgaggctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttg

SEQ ID NO: 11130 - DNA, 114 bp, Homo sapiens
agataaggcaaagaggcacttttggatttctccatctgagcagctctgtgattcattatctgttctagaaagcagcacacgcagttccagcaaaaaaaaaaaaaaaaaaaaagg

SEQ ID NO: 11131 - DNA, 562 bp, Homo sapiens
cccagggtagtggtgggtgctttatttccatgttgggtgcctgggaagtatgtagacggggtacgtgccaagcatcctcgtgcgaccgcgagacccggggagcgggggcttgccggccgtcgcactcatttacccggggacagggagaggctcttctgcgtgtagtggttgtgcagagcctcatgcatcacggagcatgagaagacgttcccctgctgccacctgctcttgtccacggtgagcttgttatagaggaagaaggagccgtcggagtccagcacgggaggcgtggtcttgtagttgttctccggctgcccattgctctcccactccacggcgatgtcgctgggatagaagcctttgaccaggcaggtcaggctgacctggttcttggtcatctcctcccgggatgggggcagggtgtacacctgtggttctcggggctgccctttggctttggagatggttttctcgatgggggctgggaaggctttgttggagaccttgcacttgtaccccttgcattcagccaagtcctgttgcaagacggtgaggacgctga

SEQ ID NO: 11132 - DNA, 583 bp, Homo sapiens
cagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatg

SEQ ID NO: 11133 - DNA, 548 bp, Homo sapiens
tatgacgtcgcatgcacgcgtacgtaagcttggatcctctagagcggccgcctactactactagcctactactactaaattcgcggccgcgtcgaccaaggaactggatggcgcgaccatctgcatccaggccggtaccaccaccgagctgaatgtgtccgactacttccgcgccaatggcctgaagtacaccccgatcaccttcgacacctccgacgaaagcgccaagtcgctggaatccggtcgttgcgacgtactgacctcggacaaatcccagctgttcgcccagcgcagcaagctggcctcgccgaaggactacgtggttctgcctgaaaccatctccaaggagcctctgggcccagtggtgcgtaacggcgacgaagagtggaccaagatcgttcgttgggtcggctatgcgctgctcaacaccgaagaagccggtatcacttcgaaaaacgtcctggaagaagccaagtcgaccaagaacccggacgttgctcgtctgctgggcgccgacggcgagtacggcaaggacctgaaactgccga

SEQ ID NO: 11134 - DNA, 497 bp, Homo sapiens
cgactcactatagggaagctggtacgcctgcaggtaccggtccggaattcccgggtcgactactactactaaattcgcggccgcgtcgaccttctggaggaatactgttggcgttcaaaagcattgctgtttcaacaatggccaagaacaaattaagagggccgaagtccaggaatgtatttcacatagccagccaaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatac

SEQ ID NO: 11135 - DNA, 536 bp, Homo sapiens
tcgcggccgcgtcgacgcccctggctctgctcccccagcctcttgttggatcagaaggtcaaggtggtctattgttgcccgcaacgcaaagggatgtggcagtttcctactaccacttctaccacatggccaaggtgcaccctgagcctgggacctgggacagcttcctggagaagttcatggtcggagaagtgtcctacggatcctggtaccagcacgtgcaggaatggtgggagctgagccgcacccaccctgttctctacctcttctatgaagaacatgaaggagaaccccaaaagggagattcaaaagatcctggagtttgtggggcactccctgccagaggagaccgtggacttcatggttcagcacacgtcgttcaaggagatgaggaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgc

SEQ ID NO: 11136 - DNA, 479 bp, Homo sapiens
atgtcgttgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgt

SEQ ID NO: 11137 - DNA, 479 bp, Homo sapiens
tatgacgtcgcatgcacgcgtacgtaagcttggatcctctagagcggccgcctactactactaaattcgcggccgcgtcgacatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtc

SEQ ID NO: 11138 - DNA, 649 bp, Homo sapiens
gaagtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagatatgagttggaaagcctcttcgagcactactgctactcccg

SEQ ID NO: 11139 - DNA, 326 bp, Homo sapiens
ttcggcacgaggtttggattgtgtggaaactatgcattttctgctcaaatgctattttaatttattacatttagaaaaaaagttgatttcaataattcatcctgcttgaagattcaaagtcagaagtatactatcatcttgaattttagctgaagaatcctatgagcatgtatgtttctgctgtaaaaacgtacttactgtatggcactcaaaaactatgttaaatgatccactaactttttttttcttggcccatgattaatggaatgtatgtaactaggtagggttcctttcttacatctagaggaagtacagccacccactga

SEQ ID NO: 11140 - DNA, 622 bp, Homo sapiens
  misc_feature 274: n = A,T,C or G
gggggccatctgccactttattttgcccgtcttgtagcatgtgggtctttcgcagcaggaagtgtgttttacaaccagagcccccgccctcctgcagcgcaggcgcagctggctgggctcctgcttcccactctccacctcatccatatttgtcctcgtccctgccagtctcgaaaaggcactctgtcacgtgtacacaggaaagggccctgacaagaggatgggactgcagttgtggctgccaggtctcactctcccttggatggtcggcggngtgggggtggaggccagggctgtagtgcagctcccgcaggtgctggctcagggggagcaggcaggctccggttttcggtaatcctcctggatggggatggtgctgccctcctcctccctggggcagctgtaacgacaaggctctgcaggctccacaggactttctcctttggttgatctatatttccttcgttgatggaggaacagggccccggccagggtgaaaacaaggaacattccagagaagatcacaaggatgcgaataaaatcggagctgcaccaggatcttttgggtggccagtgggtagaagagtcccggcaggcagctgcctgagtcagccagagtctg

SEQ ID NO: 11141 - DNA, 677 bp, Homo sapiens
  misc_feature 17, 599: n = A,T,C or G
attgttataagtcaggnaggaaggagaagttgctccttaaaaacccttgtattatgccaagaccctaatttctgtcttaaaaaagtatgctttacaccttaaagcagcacttttattttgcacattgataatgctgtatgtatactttctttttttccattttattttatttaaaattttttttattttaatagcttttagggtacaattgcattttggttacaatgctgtatgtatacttccatgtagttttcttaatcagtaaaatgatctttcatgttaaagtctctatttgttagttttccctgactgtaattttctttctaccttgtataaatgataaaaatagactctaataaactgagtgtgctctggcatactagttattgacatgtttatattcacaaatataaactccaggctggctgtttttcttggtgaatgttctccaggctggttatttttcttggtgaatgtaatgtactgtctttttagagtaagttactaagctggttactaaatcaggaatattttagttataaaactttagatttttaagaatattggccaggcacggtggctcacacctgtaatcccancacgttgggaggccaaggcgggtggatcacctgagatcgggagttcaagaccagcctggctaacatggtgaaacctgt

SEQ ID NO: 11142 - DNA, 759 bp, Homo sapiens
  misc_feature (1)...(759): n = A,T,C or G
gccgtnatactggtcactgctgctacaaancacaanncaacngtgcnnctgngtattagancnaataatnnatctttntgagnaaaaaattaaaacgctgggaatnagataaaaagncaactttttacaatgngggnaaaaatgacaccagatttgcctctgagancgatactnccaaaatggacggatcnaagcactngnnacatcnnnactccttgagcanaaanaacaaaagggccatccgtgctcctaatncgacagggacagtgaccctgaagatntgagccaaccacttcctcnctgccgataatacganctgaagccccacgcagcgtagnagaccnngcctgggtctggatcacccacgctgacttnggcgacgagtgccccaanccagaactgctggccatccgcttcctgantgctgagancgcncngnnnttcaaaacaangtttgganactgctggaaagagatcgnagagaganacaanngngcaggatcaagcaaaagtgatcntnccgaaaagnggcggaaagctngaatctctctcgnganggaagngaccaggtngatgctgaggagaaacngtacagcggctatttatnncttttgctctcnttccttacttttttaaaanatttaccctgncctctttttngggtggnttttttttcnttttcanggacgtttttaaaaactgactcacatncagggggttttttttgttttagctttgccttttananactcaaaaaac

SEQ ID NO: 11143 - DNA, 702 bp, Homo sapiens
  misc_feature 1, 12, 654, 670, 699: n = A,T,C or G
nacaattcaagnatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccattccaactaatactcacagggaatatatagagtctagaaaaaaaatntacaggtcccttaaangctgccctgcccacaaaaccataacgcangac

SEQ ID NO: 11144 - DNA, 763 bp, Homo sapiens
  misc_feature 485, 572, 603, 610, 619, 622, 626, 649, 691, 696, 697, 724,735, 739, 744, 745, 758, 762: n = A,T,C or G
gggatttgtcatttcttttgtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagttttttttcttgattaattggatgtatttcacagaatttccaactgctcacgttagttttcttccttttagagttgatctctctaatgtattagatcttcatgcctttgatagtctctctggaataagtttgcagaaaaaaacttcagcatgtgccaggaacacaacctcaccttgatcagagtattggtacaatcacatttgacgtaccaggaatgcnaaggaagatcatcttaatatgtttattcagaatcttctgtgggaaaagaatgtgagaaacaaggccatcactgcatggaggtcatangctgaagggttggggtcatcaaagacaatcncaccagngatgtcccnggngtcntgagctcttgatctgaggagccncagggctgggaggataccctgagagacaatcgattggcctcnttgcnnaattaaataagattcctaacactgttnagctctggacnaccnaaacnnggcacccttcaanaaana

SEQ ID NO: 11145 - DNA, 594 bp, Homo sapiens
  misc_feature 354: n = A,T,C or G
ggcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcangacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactg

SEQ ID NO: 11146 - DNA, 203 bp, Homo sapiens
agggagggaaagaaggaggaggggagggatagagagagagaaagagaggaaagaaagagaaagaaagaaagaggaaaagagaagaaaggaaagaaaaaagaagaaagaagggagggagggaaagaaggaggaggggagggatagagagagagagaaagagaggaaagaaagagaaagaaagaaagaggaagagaagagagaag

SEQ ID NO: 11147 - DNA, 539 bp, Homo sapiens
tccaccgcggtggcggccgctctagaactagtggatcccccgggctgcaggaattcggcacgaggggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgct

SEQ ID NO: 11148 - DNA, 130 bp, Homo sapiens
tccaccgcggtggcggccgctctagaactagtggatcccccgggctgcaggaattcggcacgagcctgggacctgtcattgccctcctgctctggagacagctttttgcagtggactcatgctatgatgt

SEQ ID NO: 11149 - DNA, 488 bp, Homo sapiens
cggcacgagggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagatgagactttgctggatctggactttgatcctttcaagcccgatgtgacacctgcaggttctgctggagtgacccactcacccatgtctc

SEQ ID NO: 11150 - DNA, 551 bp, Homo sapiens
tcacattcactcatttctctatttttaaaagtgcccagattgctcaaagatagcagaagtaggagattaaaaaaaatctggaaccacaaagttagtagtttcagatgatctggggtttggctgtgtgaggggtggcagaatgcaggtaggcgcctcagtcgtatctttctgcagcttccgttctcagctcctcacatgggggaggtagcgcactccgaggtcaactccatgtcaaaggtgagggactcaaactgccctcctgctgagggttcagcaccttcaccattatttccaaactgcatcaatgaatctaaagtgcggggggacatcggcaggtcaatggtattgctgcaggtcgttggtgtcacacagataaacttggtcttcaggtatggggcagcgctacctgggtcagcttcaggatgctcctggctctctggccgacaatactttccgaatgcctcctccttgggaatgtcaggatagagatagaccagtggagacaccaggatattggtagcatccatgatcttatagcccatgatgatttc

SEQ ID NO: 11151 - DNA, 436 bp, Homo sapiens
gaggggattgcacagtttatttccaaacactcagaggatagggggtggcctatgggtccatctgcctcccctccctgcatttggctgaatcaagaacttctcccccctgacccccaagaccctaggctgtgtccaatagagaaggcactgtcaccccccaccctgaggagacctagacaggtgaggagcatggagggtgggggaacagagttcaagtattcacagttcccccatctacacccctggattacactgtgccagagccatgagggaggatccacctctgggattcctagtggtgttgatagtccttctcccacttagaaccctccagatgaactccctactccttttccctgaaataacaaaccaagtcctaagccctgtagtctgggcaaggaggagccttagcaggccactcacccaaggcccccag

SEQ ID NO: 11152 - DNA, 568 bp, Homo sapiens
tatttaggtgacactataggaacagtttgtacaaaaaagcagctggtaccggtccggaattcccgggatatcgtcgacccacgcgtccgcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaagga

SEQ ID NO: 11153 - DNA, 558 bp, Homo sapiens
ctatttaggtgacactataggaacagtttgtacaaaaaacaggctggtaccggtccggaattcccgggatatcgtcgacccacgcgtccgcggacgcgtgggcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtatt

SEQ ID NO: 11154 - DNA, 83 bp, Homo sapiens
ctatttaggtgacactataggaacagtttgtacaaaaaagcaggctggtaccggtccggaattcccgggatatcgtggaccca

SEQ ID NO: 11155 - DNA, 496 bp, Homo sapiens
  misc_feature 453: n = A,T,C or G
tgacactatagaacaagtttgtacaaaaaacaggctggtaccggtccggaattcccgggatatcgtcgacccacgcgtccgcgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctancttgggaggcttcccctcactatcctaccccacccgctccttg

SEQ ID NO: 11156 - DNA, 635 bp, Homo sapiens
  misc_feature 453: n = A,T,C or G
gcattcaatgagaactttttatttcaattatccacaaaacaatattacaatactttataaaaatattaagtttaggctaccattattcatttaaaaaagtgtgctagaaggctgtttttgccaacttccttttttggtaagggttaacttccacattaagacactgaagacgaaaagctgttggaaaatatctccaaatttacaaagttgtttttcttggcaatttaaaaatacagaacaatttaaaatgaatacacattaagttagtgttttatccctactatacaattgttattatataaggaactgctccattcagttaaaacctaatgaataccatcaacttttcctgccttactttcctgattggatttagtacataaacgtaattttgtcacccttttgaatatgcttagaaaaattacaatatcatagttcacataaagcccttanaaaatctcatgtcacaagttgttgataagaggaaataatgacagcactcttcttaggaagaccctcttggtagagagtgtcaatactaagcagggtacgtaaacagaaaaaacaaccacaatttttagtaccagaaaccactgcaacttgcatgaagccatctgcacattttaaaaatggtt

SEQ ID NO: 11157 - DNA, 670 bp, Homo sapiens
acgcgtccgggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgcttgaaaagcggaggtttgagccacctttcaggcccaaagtgaagtcacccaaagactacagtaactttgacccagagttcctgaacgagaaagcgcgcctctcctacagcgacaagaacctcatcg

SEQ ID NO: 11158 - DNA, 423 bp, Homo sapiens
tgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgatgacagcctgaccaccacaccccccggccttcaacggtactcgccct

SEQ ID NO: 11159 - DNA, 603 bp, Homo sapiens
ccggcttccaaaagctttattggcaaatatgctctataaaagaatgatcaatcctgttgcctctaagtcaatggaatgaagagctgtgtccagggacacaccacgccgtgctgaaggagactgctgttgtgtccaccttttattcatagacccagtcatgagcacaagacttgtagtcaaccagttcttcaggcttaaaccataggctgatttctttttcagcactttttactgaatcactgccatgaatgatgttcctgccaacctgaatgcagaagtccccacgaatggtgcctggctttgaatctgctggattggtctccccaagcatcactcggcctgtcttcaccacgttcagcccctcccagaccatggccacaaccggccctgagttcatgtacttcaccagcccagggaagaatggtcggtctttcaggtcaatgtagtgctgcttcaggtgttcttcagaggcccggaggaacttcatggccacgaggcggaatcccttctgctcgaagcgcttgatgatctcgcccaccaggccgcgctgcacgccgtccggcttgatggcgatgaaggtgcgcttcagtttggccatggtcc

SEQ ID NO: 11160 - DNA, 555 bp, Homo sapiens
  misc_feature 517: n = A,T,C or G
aaaacacaacaaaataatccttttgttaaaagaatgaccctgggccctcctggccagggcctgagcacatttcagtctgttatgcaggctgagaggccaggctcctccaaggccccatgagctactggttgttgcagccctgtgaggcagaggagctgcctgcctgcttttttctcctcttgttgaggagccggttgttagaggtcttcaggtccttgatcttcacctggtcgtagtctacccgcatagtggccaaggcactggtcatctcctccttgacttcgtcccagtggtctttgtcctcctgcagcactcgggccgtgtggagtggggtctgtggcactaccatcgattggttgatccaggggtggttcatgaactgagtgatggtcagcctctctgtggggtctgtcttcaacaggaggcggatcagctgcttggcatcctcagagacttctgaccactcaggattggggaagcgtactggcccaggcgaatcatcctcttcatccccggngagatggcctggcccgtgttggagtagaagggtgggaa

SEQ ID NO: 11161 - DNA, 163 bp, Homo sapiens
tggtacgcctgcaggtaccggtccggaattcccgggtcgactactactactacaaacgcggccgccgcgacgacaactgcttatcacccctggccaaggacatccatgacaactttggtttcgtggaaggactcatgaccacagtccatgccatcgctgccac

SEQ ID NO: 11162 - DNA, 304 bp, Homo sapiens
tccaccgcggtggcggccgctctagaactagtggatcccccgggctgcaggaattcggcacgagagagccctcgcgtctgggctgcccccgaggttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacg

SEQ ID NO: 11163 - DNA, 180 bp, Homo sapiens
tccaccgcggtggcggccgctctagaactagtggatcccccgggctgcaggaattcggcacgagcttttgatgacccaccttcaactaaagcagctattgactgggtagatggtaacaaatactccggacatcctatcaaggcttcattcgctactcgccgggcacactttaatcggggt

SEQ ID NO: 11164 - DNA, 657 bp, Homo sapiens
gggtaccgggcccccccgttctgaacaccaccctccatttcattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtact

SEQ ID NO: 11165 - DNA, 133 bp, Homo sapiens
tccaccgcggtggcggccgctctagaactagtggatcccccgggctgcaggaattcggcacgagtttacaatgagttgactgaaatcctggtcaggttccagaacaaatgcagtgatatagtttttgcacgga

SEQ ID NO: 11166 - DNA, 473 bp, Homo sapiens
acgcctgcaggtaccggtccggaattcccgggtcgactactactactaaattcgcggccgcgtcgaccttctggaggaatactgttggcgttcaaaagcattgctgtttcaacaatggccaagaacaaattaagagggccgaagtccaggaatgtatttcacatagccagccaaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttata

SEQ ID NO: 11167 - DNA, 426 bp, Homo sapiens
  misc_feature 20, 386: n = A,T,C or G
ccacacgccttttggacaantgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtggaaacctatggtgaaatggctgactgctgtgcaaaaacaaggaacctgagngaaatgaatgcttcttgcagcacaaaggtggacaacccaa

SEQ ID NO: 11168 - DNA, 262 bp, Homo sapiens
tccaccgcggtggcggccgctctagaactagtggatcccccgggctgcaggaattcggcacgaggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctc
